United States Patent 9,675,668 (MODIFIED POLYNUCLEOTIDES ENCODING HEPATITIS A VIRUS CELLULAR RECEPTOR 2) - sequence listing, part 2

SEQ ID NO: 522 - DNA, 3483 bp, Homo sapiens
atggagaagtgggaggagctgaacagccatcagccaggagaggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaa

SEQ ID NO: 523 - DNA, 3861 bp, Homo sapiens
ccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagatttt

SEQ ID NO: 524 - DNA, 7322 bp, Homo sapiens
tttattcaaataataggagctctacgagtgacagatggcagaagggcacatcttctgaaaacttactaaaaattggtgaattacaaaattctaaattttaataccttaatcattttgaaagcagttcagacagaaccgaaacagaaatatttggcataaaattccaaatttttatgcttagttttatttttattattaaaagccagcttttgaaagctgtgcaaatatcaggaattgggaagaatgatgatatagtgctactggtaagaaaaatttcttcaatttgttttctctgatatcgaatttgacttggttaaaaaacgtgtgctccagcagtccagaaaagttatatttcttgatcttccattgtttgaagcactggacctttaatccactgtaggtatggacagggaagaaaggaagaccatcaatcagggtcaagaagatgaaatggagatttatggttacaatttgagtcgctggaagcttgccatagtttctttaggagtgatttgctctggtgggtttctcctcctcctcctctattggatgcctgagtggcgggtgaaagcgacctgtgtcagagctgcaattaaagactgtgaagtagtgctgctgaggactactgatgaattcaaaatgtggttttgtgcaaaaattcgcgttctttctttggaaacttacccagtttcaagtccaaaatctatgtctaataagctttcaaatggccatgcagtttgtttaattgagaatcccactgaagaaaataggcacaggatcagtaaatattcacagactgaatcacaacagattcgttatttcacccaccatagtgtaaaatatttctggaatgataccattcacaattttgatttcttaaagggactggatgaaggtgtttcttgtacgtcaatttatgaaaagcatagtgcaggactgacaaaggggatgcatgcctacagaaaactgctttatggagtaaatgaaattgctgtaaaagtgccttctgtttttaagcttctaattaaagaggttctcaacccattttacattttccagctgttcagtgttatactgtggagcactgatgaatactattactatgctctagctattgtggttatgtccatagtatcaatcgtaagctcactatattccattagaaagcaatatgttatgttgcatgacatggtggcaactcatagtaccgtaagagtttcagtttgtagagtaaatgaagaaatagaagaaatcttttctaccgaccttgtgccaggagatgtcatggtcattccattaaatgggacaataatgccttgtgatgctgtgcttattaatggtacctgcattgtaaacgaaagcatgttaacaggagaaagtgttccagtgacaaagactaatttgccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaaattttaatgaatg

SEQ ID NO: 525 - DNA, 3339 bp, Homo sapiens
tttattcaaataataggagctctacgagtgacagatggcagaagggcacatcttctgaaaacttactaaaaattggtgaattacaaaattctaaattttaataccttaatcattttgaaagcagttcagacagaaccgaaacagaaatatttggcataaaattccaaatttttatgcttagttttatttttattattaaaagccagcttttgaaagctgtgcaaatatcaggaattgggaagaatgatgatatagtgctactggtaagaaaaatttcttcaatttgttttctctgatatcgaatttgacttggttaaaaaacgtgtgctccagcagtccagaaaagttatatttcttgatcttccattgtttgaagcactggacctttaatccactgtaggtatggacagggaagaaaggaagaccatcaatcagggtcaagaagatgaaatggagatttatggttacaatttgagtcgctggaagcttgccatagtttctttaggagtgatttgctctggtgggtttctcctcctcctcctctattggatgcctgagtggcgggtgaaagcgacctgtgtcagagctgcaattaaagactgtgaagtagtgctgctgaggactactgatgaattcaaaatgtggttttgtgcaaaaattcgcgttctttctttggaaacttacccagtttcaagtccaaaatctatgtctaataagctttcaaatggccatgcagtttgtttaattgagaatcccactgaagaaaataggcacaggatcagtaaatattcacagactgaatcacaacagattcgttatttcacccaccatagtgtaaaatatttctggaatgataccattcacaattttgatttcttaaagggactggatgaaggtgtttcttgtacgtcaatttatgaaaagcatagtgcaggactgacaaaggggatgcatgcctacagaaaactgctttatggagtaaatgaaattgctgtaaaagtgccttctgtttttaagcttctaattaaagaggttctcaacccattttacattttccagctgttcagtgttatactgtggagcactgatgaatactattactatgctctagctattgtggttatgtccatagtatcaatcgtaagctcactatattccattagaaagcaatatgttatgttgcatgacatggtggcaactcatagtaccgtaagagtttcagtttgtagagtaaatgaagaaatagaagaaatcttttctaccgaccttgtgccaggagatgtcatggtcattccattaaatgggacaataatgccttgtgatgctgtgcttattaatggtacctgcattgtaaacgaaagcatgttaacaggagaaagtgttccagtgacaaagactaatttgccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgaattagcactattttctatagttacttattctctggatcattttataatttccatattaatttcaaatatgctcgtgttattcttcagtgatttccacaattgtgcattttattctttggtttaa

SEQ ID NO: 526 - DNA, 7720 bp, Homo sapiens
cttctgcctcagcctgagtagctgggatgggactacagatgcacgccaccacacatggctaatttttttattttttagagacgaggtcccatgtgagccacggtgccccaccttttaaagcaattaccgtaaggaagcaactgtctttagcaaatagaagatcataaacatccttctggagatcttgagatgttgactgtggtttatagggcaatgaaaatctacatacctgagtggggcagtgagacatgagtgccacctatgatccttccagtgagcaattctttctggtgccaggagcccaaaggaaactcagtcaaccagctgtagatgggcttgttccgagtttgttctagaagtcagaactgccagctctgaaagtaggtcacaagtgactggccatccctgggctgctcacaggaagtagctgcaaaggtcagggaaagtttttaatgactatacaggccagtgaatgacaggctttgaggagcttctcttcttggcatctgaaacagcatactttctgactaccgctgtgtgctgtgaggggctgaggatccagatgtggctgaggaaggtcctggctcatgaggaggtggaagtctgggtgcttaaacagataatccagagttttgatgcgagatgaactcattctggtgaatcactctggcttcatttggttatagtggtcaagagtttggccctggagcaaagtgtctgggtttgaatcctggctgtgctttcggtgatcttccattgtttgaagcactggacctttaatccactgtaggtatggacagggaagaaaggaagaccatcaatcagggtcaagaagatgaaatggagatttatggttacaatttgagtcgctggaagcttgccatagtttctttaggagtgatttgctctggtgggtttctcctcctcctcctctattggatgcctgagtggcgggtgaaagcgacctgtgtcagagctgcaattaaagactgtgaagtagtgctgctgaggactactgatgaattcaaaatgtggttttgtgcaaaaattcgcgttctttctttggaaacttacccagtttcaagtccaaaatctatgtctaataagctttcaaatggccatgcagtttgtttaattgagaatcccactgaagaaaataggcacaggatcagtaaatattcacagactgaatcacaacagattcgttatttcacccaccatagtgtaaaatatttctggaatgataccattcacaattttgatttcttaaagggactggatgaaggtgtttcttgtacgtcaatttatgaaaagcatagtgcaggactgacaaaggggatgcatgcctacagaaaactgctttatggagtaaatgaaattgctgtaaaagtgccttctgtttttaagcttctaattaaagaggttctcaacccattttacattttccagctgttcagtgttatactgtggagcactgatgaatactattactatgctctagctattgtggttatgtccatagtatcaatcgtaagctcactatattccattagaaagcaatatgttatgttgcatgacatggtggcaactcatagtaccgtaagagtttcagtttgtagagtaaatgaagaaatagaagaaatcttttctaccgaccttgtgccaggagatgtcatggtcattccattaaatgggacaataatgccttgtgatgctgtgcttattaatggtacctgcattgtaaacgaaagcatgttaacaggagaaagtgttccagtgacaaagactaatttgccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaaattttaatgaatgaaataaca

SEQ ID NO: 527 - DNA, 542 bp, Homo sapiens
tttattcaaataataggagctctacgagtgacagatggcagaagggcacatcttctgaaaacttactaaaaattggtgaattacaaaattctaaattttaataccttaatcattttgaaagcagttcagacagaaccgaaacagaaatatttggcataaaattccaaatttttatgcttagttttatttttattattaaaagccagcttttgaaagctgtgcaaatatcaggaattgggaagaatgatgatatagtgctactggtaagaaaaatttcttcaatttgttttctctgatatcgaatttgacttggttaaaaaacgtgtgctccagcagtccagaaaagttatatttcttgatcttccattgtttgaagcactggacctttaatccactgtaggtatggacagggaagaaaggaagaccatcaatcagggtcaagaagatgaaatggagatttatggttacaatttgagtcgctggaagcttgccatagtttctttaggagtgatttgctctggtgggtttctcctcctcctcct

SEQ ID NO: 528 - DNA, 490 bp, Homo sapiens
gcggcggccgggtcccccgcggtccctggggctggtccggccgcgagggaggccgcggaggaggcggcgcggcggcggccagtgagcggccccgatctgacagacatccctgaatcttggtgtttggacataggagtgatcttccattgtttgaagcactggacctttaatccactgtaggtatggacagggaagaaaggaagaccatcaatcagggtcaagaagatgaaatggagatttatggttacaatttgagtcgctggaagcttgccatagtttctttaggagtgatttgctctggtgggtttctcctcctcctcctctattggatgcctgagtggcgggtgaaagcgacctgtgtcagagctgcaattaaagactgtgaagtagtgctgctgaggactactgatgaattcaaaatgtggttttgtgcaaaaattcgcgttctttctttggaaacttacccagtttcaagtccaaaatctatgtc

SEQ ID NO: 529 - DNA, 2157 bp, Homo sapiens
atgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcatgacagatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattaggaggttaatatgtgggcctaatactatcgatgttgaagttacaccaatttggaaactgctcatcaaggaggttctaaatccattttatatatttcaactcttcagtgtctgtttgtggtttagtgaagactataaggaatatgcttttgccatcataatcatgtccataatttccatatctttgacagtatatgatctcagagagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggtaagcctctgctcttcagagaatctgagaagcttcttcaatgccagagcaacataggcaatatcagagctatctaattcttataaaaggtgaggtttccaatgtggagtacatttggtagtgaagggcaaaccaatctaaggctggtttcctcatctgtgcaatgaagctaataatagcatctacataatgagattgtgaggattaaatgagatgatgcagtaagaaaatccttggcactatgcctggcaaatattaaaggttcgatcatattaatataattgtacttattatgcagttatttcttgtctctctgtactgttctccgagcattgtctggtttcgaagattttccagaatatggggatcagaaaacattgctttctccagtgctcaggataactcatagattcacggggactataagtcttatttctattaatttcatattgattttatttccaagactagaaagaacaaaaa

SEQ ID NO: 530 - DNA, 4208 bp, Homo sapiens
aggcaatgagttctttccctgtaagttgggcacaaaaagatcggcatgggagcagcctcctttgagacagctgctctgagagaatgcaataagcagggagcagccagcaattcctcctagcagagggcgactcgtgggaggagttcagtttgccaagtattgtcatttgttgagagaaggtgtgtgctcaaggaggagttttaacctggaggatcattaactcttttagtcagctgaggagctgcggtggctcggcgagttggagttcatcctggaagcgtctgcacgacaaggtcagggaggaggtgtggaataactttttcatgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcatgacagatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattaggaggttaatatgtgggcctaatactatcgatgttgaagttacaccaatttggaaactgctcatcaaggaggttctaaatccattttatatatttcaactcttcagtgtctgtttgtggtttagtgaagactataaggaatatgcttttgccatcataatcatgtccataatttccatatctttgacagtatatgatctcagagagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggattactttgtaggtatgtgtggtgatggagccaatgactgtggggctctgaaaatggctcatgtgggcatctcattatcagagcaggaggcatctgtggcctcacctttcacttccaaaactccaaacattgagtgcgtacctcaccttatcaaggaaggacgtgcagctctcgttacctccttttgcatgtttaagtacatggctctgtacagcatgattcagtatgttggtgttctgctgctctactgggagacaaacagcctttcaaattaccagtttctgttccaggatctggccattacaactcttattggtgtaacaatgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatat

SEQ ID NO: 531 - DNA, 1458 bp, Homo sapiens
ggaataagaggggtaaatggaatagctgcatagcaacttggctctcaagcatcttaaatgttatcccttgacttctggcttccatggtttctgatgagaaattggctgctaatcttactgaagatcccttatagtgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatatgtgatctttcctcttaggacaggacaatactttcctttttataaaaatgagttgaggggaagtagtactgtgtatactcacggagttgtaatttttgaatttttacttcatcgatggaaaaactaatgcgtgggaaacattacaccaatctttactgtctgggttccttttctctgtagtacttttcagatttgaggctttttcttctgtttctggccttacccaacatattgttaaggataagcttagcctatgctgcaataaaaaacaactctcagata

SEQ ID NO: 532 - DNA, 4027 bp, Homo sapiens
aaaagcgcctgggaagagcaatcacaagttgtgacgattccaagttcacagaagcccaagggattttgacatttctccaaggagttagccagaagagatcctcgccggttgagttcagatggaagagaacagtaagaaggaccatcgggctttgctcaaccagggagaggaggatgaactggaggtgtttggttaccgggaccacaatgtacggaaagccttctgccttgtcgcatccgtgctgacctgtgggggccttctgctggtgttctactggagaccccagtggagagtgtgggccaactgcatcccatgccccttgcaagaagcagacactgttttgctgaggacaacagacgaatttcaaagatatatgaggaagaaggtattctgcctctacttatccacactgaagtttcctgtaagcaagaagtgggaagaatccctggtggctgaccgccactctgtcataaaccaagccttaataaagccagaattaaaactgcggtgcatggaagtgcagaaaatcaggtatgtttggaacgacctggagaagcggtttcagaaagttgggttgctagaagacagcaattcctgctctgacatccatcagacatttggattgggtctgaccagtgaagagcaagaggtcagaagattagtgtgtgggcccaacgccattgaggttgaaatccaacccatatggaagctgcttgttaaacaggttttaaatccattctatgtgttccaagccttcaccctaactttgtggctgtctcaaggttacatagaatactctgtggccatcatcattttgactgttatctccattgtcttaagtgtgtatgatttgcgacagcaatcagttaagctgcataacctcgtggaggaccacaacaaagtccaggttacaatcattgtaaaagacaaaggtttggaggagctggaatcccgtctcttggttcccggagacattcttattcttccaggaaaattttcattgccatgtgatgctgttttgattgatggaagctgcgtggtgaatgaaggcatgcttacaggagaaagtatacctgttacaaagacaccattgccccagatggagaacactatgccttggaaatgtcacagtttggaggattataggaaacacgtccttttctgtggaacagaagttatccaggtcaagccctctgggcaggggcctgtacgagcagtcgttttgcaaacaggttacaatacagccaaaggggacttagtgagatccatcctgtacccccggcctctgaacttcaaactatacagcgatgccttcaagttcatcgtgttcctggcctgccttggtgtcatgggttttttctatgccctaggggtatatatgtaccatggagttcctccaaaagatactgtgaccatggccctgatcctcctcaccgtgactgtccctccagtgctgccagctgccctgaccataggcaacgtgtatgctcagaagagactgaagaaaaagaaaatcttctgtatctccccacagagaatcaacatgtgtgggcaaataaacctcgtgtgctttgacaaaactggcactctcactgaagatgggctggacctctgggggactgtccctactgctgacaactgcttccaggaagcccacagctttgcctcaggccaggctgtgccatggagcccactgtgtgcggccatggccagctgccactctctgatccttctcaatgggaccatccagggagaccctctggacctcaaaatgtttgagggcactgcctggaaaatggaagattgcattgtagactcctgcaaatttgggacgtcagtttcaaacatcataaaaccaggaccaaaagccagtaagagtccagtggaagccatcatcaccttgtgccagtttccattttcctcgagcctgcagaggatgtccgtgatcgctcagctagctggggagaatcatttccatgtctacatgaaaggtgccccagaaatggtggccaggttctgcagatctgaaacagtgcccaagaatttcccacaggaactgaggagttacacggtgcaaggcttccgtgtcattgctcttgcccacaaaaccttaaagatggggaatctttcagaagtcgagcacttagccagagaaaaagtggagtcagagttaacatttctgggacttctcatcatggagaatcgcttgaaaaaagaaaccaaactggtcttgaaggaactgagtgaggcccgtatcaggactgtgatgattacaggtgataaccttcaaacggccattactgttgcaaagaattctgaaatgatccctccaggcagccaagtgatcattgttgaggccgatgaaccagaagaatttgttcctgcctctgtgacctggcagctggtggagaaccaagagactggacctgggaagaaagaaatctacatgcatactggaaacagttcaacccctcgtggggaaggaggaagctgttaccattttgcaatgagtgggaaatcataccaagtgatatttcagcatttcaacagcttgcttccaaaaattctggtgaatggaacagtttttgcaagaatgtctcctgggcagaaatcaagccttattgaagaatttcagaaattaaattattatgtgggcatgtgtggagatggagctaacgactgtggggctttgaaagcggctcatgcaggcatttcattatcagagcaggaagcatctgtggcatccccttttacctctaaaacaaccaacatccagtgtgtgcctcatctcatcagagaaggccgagctgctctggtttcatcctttggagtatttaaatacttgaccatgtacggcataatccagtttatcagtgcattactgctctattggcaactacaactctttggaaattaccagtatctcatgcaagatgtagccattactttgatggtctgtttaacaatgagttcaactcatgcctacccaaagctggctccatatagaccagcaggacagctcctttctccccctttactgctttcaatatttttgaattcctgtttctcctgcattgtgcagatcagtgcatttctctatgtgaagcagcagccttggtattgtgaggtctaccaatacagtgagtgttttctggccaaccaaagtaatttttcaacaaatgtgagtttggaaagaaactggactggaaatgcaactctgattcctggttcaattttaagttttgagaccaccacactgtggcccatcaccaccatcaactatatcacagtagcattcatcttttctaagggaaagccatttcgaaaacccatctatacaaactatatattttcatttctgctgctagctgccttgggcctcacaattttcattctgttttctgactttcaagttatataccgtggaatggagttgatcccaaccataacatcgtggagggttttaattttggtggtagccctcacccaattctgtgtggctttctttgtagaggattccatccttcaaaatcatgaactctggctgttgatcaaaagagaatttggattctactctaaaagtcaatataggacttggcaaaagaagctagcagaagactcaacctggcctcccataaacaggacagattattcaggtgatggcaaaaatggattctacatcaacggaggctatgaaagccatgaacagattccaaaaagaaaactcaaattgggaggccaacccacagaacagcatttctgggccaggctgtaatcagaattgtcgtcgtacatgctcaacagcattgcttttttccccaaaattaacacattgtggagaagtgatgatactctccccttacctttcctctctccattcaagcattcaaagtatattttcaatgaattaaaccttgcagcaagggaccttagataggcttattctgactgtatgctttaccaatgagagaaaaaaatgcatttcctgtatcatccttttcaataaactgtattcattttgcatagc

SEQ ID NO: 533 - DNA, 8209 bp, Homo sapiens
agctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtaaatgttggagatatagttataataaaaggcaaagagtatatacctgctgacactgtacttctctcatcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatgggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattactt

SEQ ID NO: 534 - DNA, 8270 bp, Homo sapiens
aagagctcgcccagctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattacttaaaa

SEQ ID NO: 535 - DNA, 5677 bp, Homo sapiens
gcttttctccttggcatggtcacggaatggatacctgtttgatcttcctgcactgctgagaaatcttccttttgggggagaggattaagtctgggttgaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaaactgcagaatgaaaaatggatgaatgtcaaagtgggagacatcattaaattagaaaataaccaatttgttgctgctgatttacttctcctatcaagtagtgagccacatggtctctgttatgttgaaactgctgagcttgatggggaaacgaacctaaaagtccgccatgcactatcagttacttcagaacttggagcagatatcagcagacttgcagggtttgatgggattgttgtctgtgaggtgcctaacaacaagttagataaattcatgggaatcctttcttggaaagacagcaagcattccctcaacaatgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattattctcgaaaagcaatacctgcagtggctcgaacgaccacgctcaatgaggaactggggcagattgagtacattttctccgacaaaacgggtaccctcactcaaaacatcatgacctttaaaagatgttccattaatgggagaatctatggtgaagtacatgatgacctggatcagaagacagaaataactcaggaaaaagagcctgtggatttctcagtcaaatctcaagcggatagagaatttcagttctttgaccaccatctgatggaatccattaaaatgggtgatcccaaagttcatgaattccttaggttacttgctctctgccacactgtaatgtcagaagagaatagcgcaggagagctgatttaccaagttcagtcacctgatgaaggggctctagtgactgccgctagaaattttgggttcatttttaaatcccggaccccagagaccataacaatagaagaattgggaacactagttacttatcaattacttgcctttttggatttcaacaacaccagaaaaaggatgtctgtcatagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggaaagcaaaacaaaatttgtttggacaaaacagaaatttttccaatggccatgtagtttgtgaaaaaaagcagcagctggagttggattctattgtagaagaaaccataacaggagattatgccttaatcataaatggccacagtttggctcatgccctagaaagtgatgtcaagaatgatctcctagaacttgcttgcatgtgtaagactgtaatttgctgcagggtcactccactccagaaagcccaagtggtagagctggtgaagaagtacagaaatgctgttactttggccattggtgatggagccaatgatgtcagcatgattaaaagtgctcacattggtgttggcatcagcggccaggaaggattgcaagcagtcttagccagcgactattcatttgcacagtttagatatctccaaaggcttctccttgttcatggaaggtggtcttatttccgaatgtgcaaattcttatgctatttcttctataagaattttgcatttacacttgtgcatttctggtttggtttcttctgtggtttctcagcccagactgtttatgaccagtggttcatcaccctttttaacattgtttacacatcactgcctgttttagccatggggatttttgaccaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggctatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgtgccttctctgagactcagtttcttcctctgtaaaatgaggacatactacctacctcatgtggttggttgatgattgtctgtcaaagcacaaactctgaaattattaaaaacataattatttcataaacagatgagttaagttccagttaactcaacatcagtataacagagcaattggaagagaatatgaaaaaactggaatctaaatagtcagtgaggaaggctttgataaaatgaaattgccagaaagatataaaactggttagggtcctacagggaaataaaattataaccgtggaggtacatttctctaccagaaagcaaaaataaagcatcatgtcttaatggttttctacaaatcaacttctaattctacagagtccttaatctggtccctattaaattcttggtcagacaaagttacatttcccaagagagtcaggtgacacttgagtgagtttgatggataatgagctaatgtgatatctataggtcacaattttttaaaaccaaaattttcaagtctgggataatctttcctaaatgggatcaaatgaaataatatgtgtaaaagagtcaaatgcagtcctttaccatagtaactgcctatggacgttgtctttcccttacatgcctgcctacacttaaccagatgttggttttcaatgtctaatttgtcattagtttcaccacatttgctcactttttgtaacatttttgcaagatttgaaaactttcagtaaatgttttggcactattggta

SEQ ID NO: 536 - DNA, 759 bp, Homo sapiens
ggcacagcccagcttcaccagccccagccacagccacacgtaggccggctcgttacccataaggagcgccacgcagtctccctggcgcaggccgaggtggtcgtgcagcgcccgggccacttgattgctgcgccggtccacctgcgcgtaggtgagagtctcgtcgcggaagagcagaaaaggcttgtgtggcgtctggcgcgctttctccaggaacgcccgcaggatggtgcgcgccggccgccgcttcccgtagctgcgcaccctccggcccacggcggccaccttcaagaagtagcctatgtcctggaagaagtatgggcagcagaggttcaccaggagcggcaggaacagcagtcccgccaggactgtgtagatggcggaaagcatgacggctgcggggccctctgtcccagcgagggcagagggttcaccccgggcgtgcagcgcggcgactgggcgggctccgggcggactggcgggctgcgccggggcgcacgcggcgggacgccgggctcgcgtgagatgaaggggaagacagagctcctccgctgcaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaa

SEQ ID NO: 537 - DNA, 4894 bp, Homo sapiens
aaaatgagaaagagaccagcaagagcagactaggaaaggaagagaagggaaggagaaaaggaaactagaatgcatttctgtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaaactgcagaatgaaaaatggatgaatgtcaaagtgggagacatcattaaattagaaaataaccaatttgttgctgctgatttacttctcctatcaagtagtgagccacatggtctctgttatgttgaaactgctgagcttgatggggaaacgaacctaaaagtccgccatgcactatcagttacttcagaacttggagcagatatcagcagacttgcagggtttgatgggattgttgtctgtgaggtgcctaacaacaagttagataaattcatgggaatcctttcttggaaagacagcaagcattccctcaacaatgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattattctcgaaaagcaatacctgcagtggctcgaacgaccacgctcaatgaggaactggggcagattgagtacattttctccgacaaaacgggtaccctcactcaaaacatcatgacctttaaaagatgttccattaatgggagaatctatggtgaagtacatgatgacctggatcagaagacagaaataactcaggaaaaagagcctgtggatttctcagtcaaatctcaagcggatagagaatttcagttctttgaccaccatctgatggaatccattaaaatgggtgatcccaaagttcatgaattccttaggttacttgctctctgccacactgtaatgtcagaagagaatagcgcaggagagctgatttaccaagttcagtcacctgatgaaggggctctagtgactgccgctagaaattttgggttcatttttaaatcccggaccccagagaccataacaatagaagaattgggaacactagttacttatcaattacttgcctttttggatttcaacaacaccagaaaaaggatgtctgtcatagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggaaagcaaaacaaaatttgtttggacaaaacagaaatttttccaatggccatgtagtttgtgaaaaaaagcagcagctggagttggattctattgtagaagaaaccataacaggagattatgccttaatcataaatggccacagtttggctcatgccctagaaagtgatgtcaagaatgatctcctagaacttgcttgcatgtgtaagactgtaatttgctgcagggtcactccactccagaaagcccaagtggtagagctggtgaagaagtacagaaatgctgttactttggccattggtgatggagccaatgatgtcagcatgattaaaagtgctcacattggtgttggcatcagcggccaggaaggattgcaagcagtcttagccagcgactattcatttgcacagtttagatatctccaaaggcttctccttgttcatggaaggtggtcttatttccgaatgtgcaaattcttatgctatttcttctataagaattttgcatttacacttgtgcatttctggtttggtttcttctgtggtttctcagcccagactgtttatgaccagtggttcatcaccctttttaacattgtttacacatcactgcctgttttagccatggggatttttgaccaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggctatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgtg

SEQ ID NO: 538 - DNA, 7437 bp, Homo sapiens
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgtgtgaacctggacatgggcaagatcgtgtacagctgggtgattcgaagggactcgaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagtggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccatttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttcccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttctgccttgggggattattttaatttgtacagaaacatgaattctggtatcaaaatgaggactttttattataacgctcctattttttctttatttcatggtacatgaaatgtaaagaaaactctttccagttcagaaaattattttgattttggcaaaaaaaaccccaaatcaatgcatgttatttattattttgtactattgtccatcccagacgtgtcagaatttcaaaaggtgatagatataaatggaaaataagatgaaaa

SEQ ID NO: 539 - DNA, 8106 bp, Homo sapiens
gcgcggcgcggcgcggagcgagcgggcgcagcgcggagctcgggcccatggtgcgcccgtgtccgtcggtcgggccgcgcgggcgctccgcgcgtggcccggcgctcgcgagctcgccccctcgctgcgggcccggcccgcccgctgccgccgcctcctcccccggggcggcgcggcgccggcgggcggcggcgcggaggccggaccgggcggcggcccaggcggcgcggggggcgcggcggccaaggcgggcggcgccgccgacatgacggacaacatcccgctgcagccggtgcgccagaagaagcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgtgtgaacctggacatgggcaagatcgtgtacagctgggtgattcgaagggactcgaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagtggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccatttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttcccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttctgccttgggggattattttaatttgtacagaaacatgaattctggtatcaaaatgaggactttttattataacgctcctattttttctttatttcatggtacatgaaatgtaaagaaaactctttccagttcagaaaattattttgattttggcaaaaaaaaccccaaatcaatgcatgttatttattattttgtactattgtccatcccagacgtgtcagaatttcaaaaggtgatagatataaatggaaaataagatgaaaa

SEQ ID NO: 540 - DNA, 3129 bp, Homo sapiens
atgacggacaacatcccgctgcagccggtgcgccagaagaagcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgtgtgaacctggacatgggcaagatcgtgtacagctgggtgattcgaagggactcgaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagtggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctg

SEQ ID NO: 541 - DNA, 7566 bp, Homo sapiens
tctttcactcttgggcctagcgaggcagcttatttttcctttttctttcattggtcacagttatttcttttcagtgtgtcatcttctctaagtttctgagggagtgttagcttgaggccttgccttgacataatcagatataatcagaaaaatgaaaaattccataggaaagagaactattttagccaaggtgtgcgagagaaataccgccactttcaagcactgttttcttctactggagtctgctcaatagggacgtcagctttgctggggcttcctttgacaagagaatcagaaccgactggtgacatttgtttcaatgaaagcaacagtgtgaagagtaagtagtttttcctattattcatctcactcagtggagataatgaactcctctccactgccaagatgagaaactaccatttcttacacatggacacaaagatgagaacaataaacactgagacttcaaaaaggagggaaggagaaagaggaacaagacttgaaatctacctatcagaacttgcaatttattctgatcaacaatttgcccagctaaagtactacatctgccccctcttcctgtggctgtaggggcacagcaaaggtcactggtctaacctccttaaagggactccgctaacagaaaccaccaaatggagtggagaaaaagaaaagggatcccctatccccaactccagccatctagattaagaaaagccagctgactggacagtagcacagcccagtcacctcatggacaaatttcctaggaaagaacctctcccatctattctacttatcactctcctttgaggttccggccacagatcttcgcctgctgctggaaatggccctctcagtggactcatcgtggcatcggtggcagtggagagtcagagatggcttcccccattgtccatcggaaaccacaccgctgctctctccagagaaagggagacagagctacaacttgacacagcagcgggtcgtgttccccaacaacagcatattccatcaagattgggaagaggtctccaggagataccctggcaacagaacctgcacaaccaaatacaccctcttcaccttcctgccccggaatctctttgagcaatttcatagatgggctaacctctatttcctgttcctggtgattttgaactggatgccctccatggaagtcttccacagagaaatcaccatgttaccattggccattgtcctgttcgtcatcatgatcaaggatggcatggaggacttcaagagacaccgctttgataaagcaataaactgctccaacattcgaatttatgaaagaaaagagcagacctatgtgcagaagtgctggaaggatgtgcgcgtgggagacttcatccaaatgaaatgcaatgagattgtcccagcagacatactcctccttttttcctctgaccccaatgggatatgccatctggaaactgccagcttggatggagagacaaacctcaagcaaagatgtgtcgtgaagggcttctcacagcaggaggtacagttcgaaccagagcttttccacaataccatcgtgtgtgagaaacccaacaaccacctcaacaaatttaagggttatatggagcatcctgaccagaccaggactggctttggctgtgagagtcttctgcttcgaggctgcaccatcagaaacaccgagatggctgttggcattgtcatctatgcaggccatgagacgaaagccatgctgaacaacagtggcccccggtacaaacgcagcaagattgagcggcgcatgaatatagacatcttcttctgcattgggatcctcatcctcatgtgccttattggagctgtaggtcacagcatctggaatgggacctttgaagaacaccctcccttcgatgtgccagatgccaatggcagcttccttcccagtgcccttgggggcttctacatgttcctcacaatgatcatcctgctccaggtgctgatccccatctctttgtatgtctccattgagctggtgaagctcgggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatgctaagcgactggagaccccaaaggagctggactcagatggtgaagagtggacccaataccaatgcctgtccttctcggctagatgggcccaggatccagcaactatgagaagccaaaaaggtgctcagcctctgaggaggagccagagtgcccgggtgcccatccagggccactaccggcaaaggtctatggggcaccgtgaaagctcacagcctcctgtggccttcagcagctccatagaaaaagatgtaactccagataaaaacctactgaccaaggttcgagatgctgccctgtggttggagaccttgtcagacagcagacctgccaaggcttccctctccaccacctcctccattgctgatttcttccttgccttaaccatctgcaactctgtcatggtgtccacaaccaccgagcccaggcagagggtcaccatcaaaccctcaagcaaggctctggggacgtccctggagaagattcagcagctcttccagaagttgaagctattgagcctcagccagtcattctcatccactgcaccctctgacacagacctcggggagagcttaggggccaacgtggccaccacagactcggatgagagagatgatgcatctgtgtgcagtggaggtgactccactgatgacggtggctacaggagcagcatgtgggaccagggcgacatcctggagtctgggtcaggcacttccttggaggaggcattggaggccccagccacagacctggccaggcctgagttctgttacgaggctgagagccctgatgaggccgccctggtgcacgctgcccatgcctacagcttcacactagtgtcccggacacctgagcaggtgactgtgcgcctgccccagggcacctgcctcaccttcagcctcctctgcaccctgggctttgactctgtcaggaagagaatgtctgtggttgtgaggcacccactgactggcgagattgttgtctacaccaagggtgctgactcggtcatcatggacctgctggaagacccagcctgcgtacctgacattaatatggaaaagaagctgagaaaaatccgagcccggacccaaaagcatctagacttgtatgcaagagatggcctgcgcacactatgcattgccaagaaggttgtaagcgaagaggacttccggagatgggccagtttccggcgtgaggctgaggcatccctcgacaaccgagatgagcttctcatggaaactgcacagcatctggagaatcaactcaccttacttggagccactgggatcgaagaccggctgcaggaaggagttccagatacgattgccactctgcgggaggctgggatccagctctgggtcctgactggagataagcaggagacagcggtcaacattgcccattcctgcagactgttaaatcagaccgacactgtttataccatcaatacagagaatcaggagacctgtgaatccatcctcaattgtgcattggaagagctaaagcaatttcgtgaactacagaagccagaccgcaagctctttggattccgcttaccttccaagacaccatccatcacctcagaagctgtggttccagaagctggattggtcatcgatgggaagacattgaatgccatcttccagggaaagctagagaagaagtttctggaattgacccagtattgtcggtccgtcctgtgctgccgctccacgccactccagaagagtatgatagtcaagctggtgcgagacaagttgcgcgtcatgaccctttccataggtgatggagcaaatgatgtaagcatgattcaagctgctgatattggaattggaatatctggacaggaaggcatgcaggctgtcatgtccagcgactttgccatcacccgctttaagcatctcaagaagttgctgctcgtgcatggccactggtgttactcgcgcctggccaggatggtggtgtactacctctacaagaacgtgtgctacgtcaacctgctcttctggtatcagttcttctgtggtttctccagctccaccatgattgattactggcagatgatattcttcaatctcttctttacctccttgcctcctcttgtctttggagtccttgacaaagacatctctgcagaaacactcctggcattgcctgagctatacaagagtggccagaactctgagtgctataacctgtcgactttctggatttctatggtggatgcattctaccagagcctcatctgtttctttatcccttacctggcctataagggctctgatatagatgtctttacctttgggacaccaatcaacaccatctccctcaccacaatccttttgcaccaggcaatggaaatgaagacatggaccattttccacggagtcgtgctcctcggcagcttcctgatgtactttctggtatccctcctgtacaatgccacctgcgtcatctgcaacagccccaccaatccctattgggtgatggaaggccagctctcaaaccccactttctacctcgtctgctttctcacaccagttgttgctcttctcccaagatactttttcctgtctctgcaaggaacttgtgggaagtctctaatctcaaaagctcagaaaattgacaaactccccccagacaaaagaaacctggaaatccagagttggagaagcagacagaggcctgcccctgtccccgaagtggctcgaccaactcaccacccagtgtcatctatcacaggacaggacttcagtgccagcaccccaaagagctctaaccctcccaagaggaagcatgtggaagagtcagtactccacgaacagagatgtggcacggagtgcatgagggatgactcatgctcaggggactcctcagctcaactctcatccggggagcacctgctgggacctaacaggataatggcctactcaagaggacagactgatatgtgccggtgctcaaagaggagcagccatcgccgatcccagagttcactgaccatatgaggagctgcagaaatctgtacaaactcaacagaggccacctagtcactggtccacataacccttgaccccttcttcttcatagaggaaacaatgtgccagtcttattcttttcttcaacaaccttgacttccatggaggaagtgctggccccaaggggtctgacacaaagacgggaaacccagtcggcctctagttttctgctgctctcaggcagcacatcttgcaaacagtttggagaaggaggctgtttttgttgaatcgagttctcaaatcggtttagaccaaagccattcttctgaccctctagataagcgtagcctacaacccagtgccgtaagtttccaagattcaagaagtgtatcaacccaggcaatatctcaggatatggaagtttctgggtttatttacccctcagtgcccagagttaaagtttcagaagagacttgtgcacataagggcttcatctcaagtgtattgcagtaatggctgaatcggggttaacatcccttccaggcacagcgagttggttctgctttttgcctgtaagccaaagaaaagccacatctaaaaagctactactaaaagccagaaagaaaagtggatttgaactcagtgtcacagactcttctgagtgttttagggtcacagctagtgtaagaggcatgaagaatagacatgcaaaagggaacgggtgcaccagagacccctgttttggctgacagaccatatgtcccaccagctggggaatctgacaagaggacataggtggcactctttttttaaagctatttattgtatctatttttaaataaaattgcccatcctcattcagctcttagaacaaaagcaaaaaaccctgtaaatcaggagatataagcacatctgcacccagaataggcccatatgatagggcaaccctgagcttaaacaatgacatcttcaagggtagaactaatctgaaaccccattcagcctattccagaatggggataggctgaaacccccttccagcctctggaagacactggcctgcatcagttagagtcagagcaagtgtcacttcacagggaaaagaaggattatatagacttcctatccctagagtttataaatgtcaactatataaaaaaagctcaaaacagtgttaaaggaatgaacagtagaattttaataggctgtccaaagaagccaggtctgctgtgggcaagtatagcctaaccctagtcttgtaaaataagccagaaagggttactgagccaccttaagctagtacctatatagtaggcaaaaagtacagaaatagatgcaataagtgtggtgagtctttgagcctacgagtcatgccaccagccataagttgacctatcacttgagaacctcctcagcaaagatgccagaaaacattcaatcaagttggcaaatgacacagggagctggccctctgaccatcttcctggcaaacctggactggaagggccatttgcagcactgtcctggagctaatacactgtttcactgcctctgccatataatgatgccagcactagccagctggtgggtatttggaggaatcctgcatgaggattgcccaataaggggcaggtacacatacctggcaaagtgatgatgatgtgaattgtttccagtgaggggattgagtcaaaacttggatctcaggtacctcaatttttcccccaatttctggctactactaaaagccagaaagaacagaacagtggcctcaggagatctgagtttgaatccttgctctctaggatgcaggtggcttgaagcagaatgccacacctgcaagttgattagaactgcctttcttcccaggcttgacataggtattaagtcaaaattacatgaaacccagtggtaaaaaagcctctgaaagctgtaacaccctcagtaataacaaaagggatttttatttcacagctaaagggaaaataggtggagaagttaaaaaataatgtctgatcctgttcctaagttccaaactatagccaacactctgatgctgctctttttcttgtaggaccaaccgtcccagtttgcctgggactttctcatttttacagagtcccaaatcctaggaaactggagcaactggtacaactggtcacctactcttgcccctctgtaaatcaagccaactgtgaccatccaatgtgccatcttacagggaaaagttataaccactattcccctataacataatgctaatgattgtacttagtacatttttatacttttatgatattttactgattggaaatgtcatcctttattaaaaataaacatggttttccatagttgcctgccaa

SEQ ID NO: 542 - DNA, 6655 bp, Homo sapiens
gacgggaggaggagcggagggagaagtaggttgcgagctcagcacaggctccggcgctggctcccgcagctgagtttgggagatgtctaagtgattttttttttttcccggaaggcaaatggctggcgtggaagcacaacccgctttcactcttcgaatttgtgcttagctcttttcttgtaccttgcgactcgtgaccaacatgctgtgatgtgtgccgagggaggaattggtcagctacacaacctggatcttaccacagtttggatatgactgaggctctccaatgggccagatatcactggcgacggctgatcagaggtgcaaccagggatgatgattcagggccatacaactattcctcgttgctcgcctgtgggcgcaagtcctctcagacccctaaactgtcaggaaggcaccggattgttgttccccacatccagcccttcaaggatgagtatgagaagttctccggagcctatgtgaacaatcgaatacgaacaacaaagtacacacttctgaattttgtgccaagaaatttatttgaacaatttcacagagctgccaatttatatttcctgttcctagttgtcctgaactgggtacctttggtagaagccttccaaaaggaaatcaccatgttgcctctggtggtggtccttacaattatcgcaattaaagatggcctggaagattatcggaaatacaaaattgacaaacagatcaataatttaataactaaagtttatagtaggaaagagaaaaaatacattgaccgatgctggaaagacgttactgttggggactttattcgcctctcctgcaacgaggtcatccctgcagacatggtactactcttttccactgatccagatggaatctgtcacattgagacttctggtcttgatggagagagcaatttaaaacagaggcaggtggttcggggatatgcagaacaggactctgaagttgatcctgagaagttttccagtaggatagaatgtgaaagcccaaacaatgacctcagcagattccgaggcttcctagaacattccaacaaagaacgcgtgggtctcagtaaagaaaatttgttgcttagaggatgcaccattagaaacacagaggctgttgtgggcattgtggtttatgcaggccatgaaaccaaagcaatgctgaacaacagtgggccacggtataagcgcagcaaattagaaagaagagcaaacacagatgtcctctggtgtgtcatgcttctggtcataatgtgcttaactggcgcagtaggtcatggaatctggctgagcaggtatgaaaagatgcattttttcaatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccaggcttttagacaaatttagtcagattacacctcggctctttatgccactagatgagaccatccaaaatccaccaatggaaactttgtacattatcgactttttcattgcattggcaatttgcaacacagtagtggtttctgctcctaaccaaccccgacaaaagatcagacacccttcactgggggggttgcccattaagtctttggaagagattaaaagtcttttccagagatggtctgtccgaagatcaagttctccatcgcttaacagtgggaaagagccatcttctggagttccaaacgcctttgtgagcagactccctctctttagtcgaatgaaaccagcttcacctgtggaggaagaggtctcccaggtgtgtgagagcccccagtgctccagtagctcagcttgctgcacagaaacagagaaacaacacggtgatgcaggcctcctgaatggcaaggcagagtccctccctggacagccattggcctgcaacctgtgttatgaggccgagagcccagacgaagcggccttagtgtatgccgccagggcttaccaatgcactttacggtctcggacaccagagcaggtcatggtggactttgctgctttgggaccattaacatttcaactcctacacatcctgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaagttcctgtgctattgagcaaggaaacttatctctgtgtgaaactgctttagatcaaggctactctgaaactaaggcctttgagatggctggaccctccaaaggtaaagaaagctagataccctccttggagttgcaagtattctttcaaggttggaagagggattttgaagaggtatctctccaagcaagaatgacttgtttttccataagggacatgagcattttactaggcttggaagagctgacatgatgagcattattgtatgtttgtatatacatttgtgatagagggctagagtttgacctagagagagtttaaggaagtgaaatatttaattcagaaccaaatgcttttgtaaaactttttggattttgtaaaagcattttcattctcttagaaattcaagtattttcaaggggagtcatttgagatatatttattttactaggagatcttatattctagggaaatgctttaaatggtcaggctccagtcggaatttttttaagaaaaaagtagtttttaatacattggttaggactcagaggaaatacggaaaaaacattgtagatggttaatttacagataaaatcccaagagccttttaaacaacaaggtacctaaaatagggtataattatactgcttaaaatacagttagtgcctattaatagctttttatttcctatgggaagatgcttttggtcttctggctgaagatgtaggcatacctctcactcatttcaatgttttcctgaggtggagccttcattggaaaggggaaagagggattctagggtttcatcagggaccaggaatgcattcctctgtcaggttccaatcaagagaagaccttttatgagatctgcctctgtatagatgttgtcagttaggaaactgaagccataggtcaggcagacatcagctcagcctgtggcccattgggtgatttcctgtattttaaaactgacagtagcctgatcaaagtgatacaatcaatttcaaaacaatcttccagagaccacttgaaggttcatagtttttacaataccctgagacttttcaggtgttggagcctctaaaatatgagatataaacagaaactaatacaagttgttctctggaggtttctatgaggttcttagaaaaatttggttttaaaatcatttgaggacaggaatgtctatagcaagtttactcctattgcgaatcatgtatgctggctttagttgtaacaaacgattttattctaagtaaggccaggtgctactataaaatcatatattcctgttgaagttcttttgaagtcctatctctatttattatatttgaaagttgtcagccaccagtcatccagaatttccttcctgaatctccatgctcatatgcaatgtctacatcaaggtcttcttaatgactattattctcagggtttagttttctaccttctgcctactattttggtctgacatttttgtagccttctgttattattggaaatagtctcttacataagctgatttcgagaactttcaaaatctcacatagctaatggaagttgctttctgctttcttatgactgtttttataaataaactgtttcataaataatgtatactggaaaattgtcatcactcttgtaaacatttgccaaatccaactgtaattagtaccagaacttagaaggaaagtcacaaagcatgccttttaccagaatattgctttgccttttcttatatggaaaatcactgatgtcatatcatttattatcctcacagcagctggcattcattccctgaaatcgtcgtctcctgataaacaataatttagagatatgttcacttgtaaataaaaaggttagaatctaaggacaaagaatgatccaaaaatactaaggaaaaagaacaattttcaattttcagaaatgaattatctgtacatatgaatagaggaaaatactgagtgctaatgttacagggccacaatctcatatccacaattccaaaatctccaaacctctgaaaactgaaatatttttcataaattaggcgtaaattctatgccctgaacaaatgtaaagctatttatgtactttgcttaatgtaatcattcatatactttgctacaaaaatattaatatatttcattactgaatgctaaactgtatttctttttaaaatttggaaaatttttaattctgaaacacaatctagaccttag

SEQ ID NO: 543 - DNA, 2550 bp, Homo sapiens
gagcggagggagaagtaggttgcgagctcagcacaggctccggcgctggctcccgcagctgagtttgggagatgtctaagtgattttttttttttcccggaaggcaaatggctggcgtggaagcacaacccgctttcactcttcgaatttgtgcttagctcttttcttgtaccttgcgactcgtgaccaacatgctgtgatgtgtgccgagggaggaattggtcagctacacaacctggatcttaccacagtttggatatgactgaggctctccaatgggccagatatcactggcgacggctgatcagaggtgcaaccagggatgatgattcagggccatacaactattcctcgttgctcgcctgtgggcgcaagtcctctcagacccctaaactgtcaggaaggcaccggattgttgttccccacatccagcccttcaaggatgagtatgagaagttctccggagcctatgtgaacaatcgaatacgaacaacaaagtacacacttctgaattttgtgccaagaaatttatttgaacaatttcacagagctgccaatttatatttcctgttcctagttgtcctgaactgggtacctttggtagaagccttccaaaaggaaatcaccatgttgcctctggtggtggtccttacaattatcgcaattaaagatggcctggaagattatcggaaatacaaaattgacaaacagatcaataatttaataactaaagtttatagtaggaaagagaaaaaatacattgaccgatgctggaaagacgttactgttggggactttattcgcctctcctgcaacgaggtcatccctgcagacatggtactactcttttccactgatccagatggaatctgtcacattgagacttctggtcttgatggagagagcaatttaaaacagaggcaggtggttcggggatatgcagaacaggactctgaagttgatcctgagaagttttccagtaggatagaatgtgaaagcccaaacaatgacctcagcagattccgaggcttcctagaacattccaacaaagaacgcgtgggtctcagtaaagaaaatttgttgcttagaggatgcaccattagaaacacagaggctgttgtgggcattgtggtttatgcaggccatgaaaccaaagcaatgctgaacaacagtgggccacggtataagcgcagcaaattagaaagaagagcaaacacagatgtcctctggtgtgtcatgcttctggtcataatgtgcttaactggcgcagtaggtcatggaatctggctgagcaggtatgaaaagatgcattttttcaatgttcccgagcctgatggacatatcatatcaccactgttggcaggattttatatgttttggaccatgatcattttgttacagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgtaagtatgaatgcatgactagagtcttgcacatccacaatgtatgatgagagaacagccttgtaattatgatagagtcaaactctgttgtcttttctaccttagaagagactacatgattgcagctcagcaagatcaccacacataattagaagtataaacaaacaatatcacactagtctacttttaaaaaataactcaatgttgagaggtagtataccatttctgaaaaaaaaaaaggagaatatttctggccagggctgattatgtgtgagcctgaagaaggctgccttggtttaagaatcatggctcactcttagaaccagcaaagcttaccagagttatctcgtagtcagataagcaagtgtaatttatagggacattcataggccatgtggtacattgaaggcctttttattgctctgtaatctcccaaatcccaccaaacttgtggtttttccctattcctggctccagaaggtcattttctaatatatcaatttcagagctcaacagaatgtgttcatgagttccagtgggaagtgtcaggaactgtctagtcacatccattaacaaatccattttactccagaaaaactagaggaccatgtagatgatggggaaaagagggaaaggtgctgtgtgaaaaaaattagaaatttttgctgtatttaaaattacctgtataaaagttcaatttcc

SEQ ID NO: 544 - DNA, 6115 bp, Homo sapiens
ttacaaggatcacaggggttggtacaagttgcttgataatctgcagcattctctctgagatttagctgccattgtgttgccaaatttctgcatgtcagtatgcagatggtcccatctctccctccagcctctgagtgtgctggagaagagaaacgagttggcacacgcacagtgtttgttggcaatcatccagtttcggaaacagaagcttacattgcacaaagattttgtgataatagaatagtctcatctaagtatacactttggaattttctcccaaagaatctgtttgaacagtttagaagaattgcaaatttttattttctcataatcttccttgtacaggtcacagtagacacaccaactagcccagttaccagtggacttccacttttctttgttataactgttacagccatcaagcagggatatgaggattgtctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccagattgtcagaatggtgaagaatttaaaaggcagcccaataactctgtcgataggtgatggtgccaatgatgttagtatgatcttggaatcccatgtgggaataggtattaaaggcaaagaaggtcgccaagcagctaggaatagcgattattctgttccaaagtttaaacacttaaagaaactgctgttggctcatggacatctatattatgtgagaatagcacaccttgtacagtacttcttctataagaacctttgtttcattttgccacagtttttgtaccagttcttctgtggattctcacaacagccactgtatgatgctgcttaccttacaatgtacaatatctgcttcacatccttgcccatcctggcctatagtctactggaacagcacatcaacattgacactctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggagaaatctgagctgtagaagggcatctgactcattatccgccagaccttcagtcagacctcttcttttacgaacattctcagacgaatctaatgtattgtaacagaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatgattg

SEQ ID NO: 545 - DNA, 3426 bp, Homo sapiens
ttacaaggatcacaggggttggtacaagttgcttgataatctgcagcattctctctgagatttagctgccattgtgttgccaaatttctgcatgtcagtatgcagatggtcccatctctccctccagcctctgagtgtgctggagaagagaaacgagttggcacacgcacagtgtttgttggcaatcatccagtttcggaaacagaagcttacattgcacaaagattttgtgataatagaatagtctcatctaagtatacactttggaattttctcccaaagaatctgtttgaacagtttagaagaattgcaaatttttattttctcataatcttccttgtacaggtcacagtagacacaccaactagcccagttaccagtggacttccacttttctttgttataactgttacagccatcaagcagggatatgaggattgtctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccagattgtcagaatggtgaagaatttaaaaggcagcccaataactctgtcgataggtgatggtgccaatgatgttagtatgatcttggaatcccatgtgggaataggtattaaaggcaaagaaggtcgccaagcagctaggaatagcgattattctgttccaaagtttaaacacttaaagaaactgctgttggctcatggacatctatattatgtgagaatagcacaccttgtacagtacttcttctataagaacctttgtttcattttgccacagtttttgtaccagttcttctgtggattctcacaacagccactgtatgatgctgcttaccttacaatgtacaatatctgcttcacatccttgcccatcctggcctatagtctactggaacagcacatcaacattgacactctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccagggttcatcacttaatttcctcttctgcataa

SEQ ID NO: 546 - DNA, 6010 bp, Homo sapiens
ttacaaggatcacaggggttggtacaagttgcttgataatctgcagcattctctctgagatttagctgccattgtgttgccaaatttctgcatgtcagtatgcagatggtcccatctctccctccagcctctgagtgtgctggagaagagaaacgagttggcacacgcacagtgtttgttggcaatcatccagtttcggaaacagaagcttacattgcacaaagattttgtgataatagaatagtctcatctaagtatacactttggaattttctcccaaagaatctgtttgaacagtttagaagaattgcaaatttttattttctcataatcttccttgtacaggtcacagtagacacaccaactagcccagttaccagtggacttccacttttctttgttataactgttacagccatcaagcagggatatgaggattgtctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccagattgtcagaatggtgaagaatttaaaaggcagcccaataactctgtcgataggtgatggtgccaatgatgttagtatgatcttggaatcccatgtgggaataggtattaaaggcaaagaaggtcgccaagcagctaggaatagcgattattctgttccaaagtttaaacacttaaagaaactgctgttggctcatggacatctatattatgtgagaatagcacaccttgtacagtacttcttctataagaacctttgtttcattttgccacagtttttgtaccagttcttctgtggattctcacaacagccactgtatgatgctgcttaccttacaatgtacaatatctgcttcacatccttgcccatcctggcctatagtctactggaacagcacatcaacattgacactctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatgattg

SEQ ID NO: 547 - DNA, 3486 bp, Homo sapiens
ttacaaggatcacaggggttggtacaagttgcttgataatctgcagcattctctctgagatttagctgccattgtgttgccaaatttctgcatgtcagtatgcagatggtcccatctctccctccagcctctgagtgtgctggagaagagaaacgagttggcacacgcacagtgtttgttggcaatcatccagtttcggaaacagaagcttacattgcacaaagattttgtgataatagaatagtctcatctaagtatacactttggaattttctcccaaagaatctgtttgaacagtttagaagaattgcaaatttttattttctcataatcttccttgtacaggtcacagtagacacaccaactagcccagttaccagtggacttccacttttctttgttataactgttacagccatcaagcagggatatgaggattgtctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccagattgtcagaatggtgaagaatttaaaaggcagcccaataactctgtcgataggtgatggtgccaatgatgttagtatgatcttggaatcccatgtgggaataggtattaaaggcaaagaaggtcgccaagcagctaggaatagcgattattctgttccaaagtttaaacacttaaagaaactgctgttggctcatggacatctatattatgtgagaatagcacaccttgtacagtacttcttctataagaacctttgtttcattttgccacagtttttgtaccagttcttctgtggattctcacaacagccactgtatgatgctgcttaccttacaatgtacaatatctgcttcacatccttgcccatcctggcctatagtctactggaacagcacatcaacattgacactctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccagggtaacgaaacgcctcccttcctcaggaacatctgctatcttcatgctttctcaaacttccagcaatcacagtttctcttggagtgaataa

SEQ ID NO: 548 - DNA, 6924 bp, Homo sapiens
cgctgcgcagcagcaacgacacaaagcctgactttacaacctcagagaaagtggaagtaagaaggcttaggtgggcaggcaggacgagagaaagactgagaggagggaaagccgcgtaggtgggagtacagcggcgcgagggtcgagggggaaccctcgtcggtgcagatgaggagggtgggctttcagaactagtcccccctcgcaccccgccccgcccctcccgcgctggggtcttcacggtgccctgcctcagagcccggctccaccacgcccggaagagggagtctggccgtcggctggctcagggcgggccggttggctgtacccaggctccctggcccgagtgcgggaccagagcgcggggcggcgcggcagccgcggaccgaggaggggctgcgagcgaaacggcgcggcgcggcacggcggacgagttagggccggggcgagggaggctgtggctcccgacagagacaggggagtagtgtcgggctgaggcgaggtgaggcgcggggtgcctcgggagggttccccgtgccccgaggggggcggccgcggagtccagcggggaggcgggcggtggtgccgcgtcggggaagagcgcatcccgcggggtgccgagcccggcgctggcggagagacgggggcgccccctccccacaggaggagcctcgcgctcctccgccatccttcccccgcgcggcgggctcgccttctcagtgggtgctgcgcgagctgccggcccggggtgccggggccagataagggcgatccgcggggccgccgcccccgggtcaggcaggccgggggcgggccgcgagtgaggcggggcggcggctaggctgcgggcggctggggggcgggggagcgcggagagccgaggggggcaggcggcgagcgggtggcccggccgcccgcctcgctgctccgcttggcgccgccggcccacgccgcagtgtgttttgtggacggcgccttcccagacagcccggtagagcccagctcagcgcccggcagccttcgacgcgatgttccgccggagcttgaatcgtttttgtgctggagaagagaaacgagttggcacacgcacagtgtttgttggcaatcatccagtttcggaaacagaagcttacattgcacaaagattttgtgataatagaatagtctcatctaagtatacactttggaattttctcccaaagaatctgtttgaacagtttagaagaattgcaaatttttattttctcataatcttccttgtacaggtcacagtagacacaccaactagcccagttaccagtggacttccacttttctttgttataactgttacagccatcaagcagggatatgaggattgtctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccagattgtcagaatggtgaagaatttaaaaggcagcccaataactctgtcgataggtgatggtgccaatgatgttagtatgatcttggaatcccatgtgggaataggcaaagaaggtcgccaagcagctaggaatagcgattattctgttccaaagtttaaacacttaaagaaactgctgttggctcatggacatctatattatgtgagaatagcacaccttgtacagtacttcttctataagaacctttgtttcattttgccacagtttttgtaccagttcttctgtggattctcacaacagccactgtatgatgctgcttaccttacaatgtacaatatctgcttcacatccttgcccatcctggcctatagtctactggaacagcacatcaacattgacactctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatgattgata

SEQ ID NO: 549 - DNA, 606 bp, Homo sapiens
ttgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaagatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcag

SEQ ID NO: 550 - DNA, 3113 bp, Homo sapiens
tgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggagaaatctgagctgtagaagggcatctgactcattatccgccagaccttcagtcagacctcttcttttacgaacattctcagacgaatctaatgtattgtaacagaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatgattg

SEQ ID NO: 551 - DNA, 3165 bp, Homo sapiens
actctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccagggttcatcacttaatttcctcttctgcataaaaagtatagtaaaaacttcgttatccaatgcaggtgaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatg

SEQ ID NO: 552 - DNA, 628 bp, Homo sapiens
tttataagtagatgcaacacctcatttatacctccttatctcatacagaagagctaagattggcagaaatgatttcacagaagccacttgcttggagcagactaccatgacaagccagtctcaggggatccaccagcttcttcaggcagaaaaacgggccaaggacaagctagaggaagccaagaagagaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaat

SEQ ID NO: 553 - DNA, 678 bp, Homo sapiens
tttataagtagatgcaacacctcatttatacctccttatctcatacagaagagctaagattggcagaaatgatttcacagaagccacttgcttggagcagactaccatgacaagccagtctcaggggatccaccagcttcttcaggcagaaaaacgggccaaggacaagctagaggaagccaagaagattctgcatctacttttcctaaaacgaagagactgggactgcttctggaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaa

SEQ ID NO: 554 - DNA, 646 bp, Homo sapiens
tttataagtagatgcaacacctcatttatacctccttatctcatacagaagagctaagattggcagaaatgatttcacagaagccacttgcttggagcagactaccatgacaagccagtctcaggggatccaccagcttcttcaggcagaaaaacgggccaaggacaagctagaggaagccaagaagaagactgggactgcttctggaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaat

SEQ ID NO: 555 - DNA, 611 bp, Homo sapiens
tgagttatatgttaatttctaaaagaataaatgaacccattacttcccagatttcacagaagccacttgcttggagcagactaccatgacaagccagtctcaggggatccaccagcttcttcaggcagaaaaacgggccaaggacaagctagaggaagccaagaagagaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaa

SEQ ID NO: 556 - DNA, 449 bp, Homo sapiens
gccacttgcttggagcagactaccatgacaagccagtctcaggggatccaccagcttcttcaggcagaaaaacgggccaaggacaagctagaggaagccaagaagaagactgggactgcttctggaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctgg

SEQ ID NO: 557 - DNA, 704 bp, Homo sapiens
gccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctc

SEQ ID NO: 558 - DNA, 1979 bp, Homo sapiens
ggagaggagggtcaccaactccaggcagggctgctaagtttattacaaacaggcaagactagaatatgtttccactttagtgagtggaaacctaatcattcataggtatcctgtacacacagaacaactatgatgaagagtgaggcctaaatcagaggagacgaggacaataatagtagtagtggtcatgatgataataataactaccagacatgaagattaaccatgcctaacattgtgttaaacgtctcacttctttcatttaatccttacaataatccaatgatgtagctgctattatttttattatacagatgaagaaactgagggcttgaggggtatactgctttgccaaagtcgtacaaatggtaagtgcagaaccaggatctgaattccgtcagtctgactgcagagtccacgccgacaccgtggaagctggtgatgcccattaggccctgtctgggcatgaagaggatgccctccctcatgagctggaacacagcatcccctgttgtgggtgtggctctcttaaagaccatctggtgaattttgcttgtgctggtttcttattaaacaaccttcagatttggcttcacgtgcaactcacatagagggaaaggagaccatgatccgccaacatgacagctgtatttttcattagtaaattagcaaactggctgcctgggtcaccatgcatacctgttaaggtgagcccgccccagagctaaaggctaccatgtgccaacttaactgagattctgagtgtgcaaggataacccccgtcatggccccgggtgccaaggaaatcccttttagcctcctcttggcagacttggccagccttccccagtgacagcctggctctttggattcaagctgcctggtcagactgcaagggtcatctgtacaaagaaggaagcaacagtgccaggttccagcgtgcgttccaagttccacattctgtgtgcagactcccaacgccagagcaaaggcaggcccctggcaggggactgctgagaaagtggaactccagagacactcctgaaattgtcctaagtcaaaggagccaaacggtgtacgagctccctctctgccgtcccctctgagagcagccatggccctgagtgatgtcgatgtgaaaaagcagattaagcacatgatggctttcattgagcaggaagccaatgagaaagcagaggaaatcgatgccaaggctgaggaagagtttaacattgagaaaggacgcctcgtgcaaacccaacgactgaagattatggagtattatgagaaaaaggagaagcagatagagcagcagaagaaaatcctgatgtccaccatgaggaatcaggcgaggctgaaagtcctgagagcccgaaatgacctcatctcagatttgctcagtgaggcgaagctgagactcagcaggattgtggaggacccagaggtctaccaggggctgctggataaactggtgctccagggtctgctccgactgctggaacctgtgatgattgtacgctgccggccacaagacctcctcctggtggaggctgctgtacaaaaagccatccccgagtacatgacaatttcccagaaacatgtggaggtccagattgataaagaggcatacctggctgtgaatgcagctggaggtgtggaggtctacagtggcaatcagagaataaaggtttcaaataccttggaaagccgactggatctctcagccaagcaaaagatgccagaaatacgaatggccttgtttggtgctaacaccaacagaaagttctttatataagcctctgggaagtgaagctagtgttgaaccactaaaccataaaagtttaagttttttggggaaaggaaactagtagtgtttcctcctctttgatgctctgatactgttctgtttttcttcacgaaataccctttggatagctaaagtgttaactttgaaataaagcccaaattaatgctcagaa

SEQ ID NO: 559 - DNA, 1559 bp, Homo sapiens
cgcggccctgccggcgcacccgagccccactccctgcgagggccgcgcggaggggcgcgcaggaggaggaggagccgaggaccgcggaggggaggaggggagtcgcctggggagccgagggctcctcgcgcaagtgcccgcagcgcccggaagcgtccaaaggccccgatgctgggagaagacgtggaggcctctcggggaaccacgacgacctccacgatgacgcaatagtcatgccaaattatacatgcatatttcacctccacccggaaggccagagccatcctctcggcctctaagtgcacaacggaactagaaatcaaggaggagagaccaaaagggaggcctgaactctcaaactccgaatctgatttccactctcccaggaagtcttcggaaatcactgtggattgtcaatacaggagtccatactgactgaatccctaattttggcctgtattcttctccctctgtgaaccatcttcttagaagtcactgaaccaagagtgccagaaaaccatcccaagactcacacagagttgttcttccatagtggatgttttggccactggacatcagaaccacattttgggtttgaagaatcttctacatgctgagaaagtggaactccagagacactcctgaaattgtcctaagtcaaaggagccaaacggtgtacgagctccctctctgccgtcccctctgagagcagccatggccctgagtgatgtcgatgtgaaaaagcagattaagcacatgatggctttcattgagcaggaagccaatgagaaagcagaggaaatcgatgccaaggctgaggaagagtttaacattgagaaaggacgcctcgtgcaaacccaacgactgaagattatggagtattatgagaaaaaggagaagcagatagagcagcagaagaaaatcctgatgtccaccatgaggaatcaggcgaggctgaaagtcctgagagcccgaaatgacctcatctcagatttgctcagtgaggcgaagctgagactcagcaggattgtggaggacccagaggtctaccaggggctgctggataaactggtgctccagggtctgctccgactgctggaacctgtgatgattgtacgctgccggccacaagacctcctcctggtggaggctgctgtacaaaaagccatccccgagtacatgacaatttcccagaaacatgtggaggtccagattgataaagaggcatacctggctgtgaatgcagctggaggtgtggaggtctacagtggcaatcagagaataaaggtttcaaataccttggaaagccgactggatctctcagccaagcaaaagatgccagaaatacgaatggccttgtttggtgctaacaccaacagaaagttctttatataagcctctgggaagtgaagctagtgttgaaccactaaaccataaaagtttaagttttttggggaaaggaaactagtagtgtttcctcctctttgatgctctgatactgttctgtttttcttcacgaaataccctttggatagctaaagtgttaactttgaaataaa

SEQ ID NO: 560 - DNA, 1845 bp, Homo sapiens
gagaacaaggacgaatgtagatcatggaaggacctgaaaagtactgtttctcgctatcttagctttagctaagtaaccttcaaggcgcgagaaagacataggactccgattccttgcctctgaagaatgaatcctctttcaaagtttcagctaaccatgagatggcgctgtgaccaaagacgaaaggtggagaaagacaaggcgtgcacgcttcgctcctagtctttggcctggcgcgtgccgcgtattgcgcagccgcagggaagctggatggggaggggttgggaggcgaaccggaattgaggggtggttccgcggtgcgcgcgcctcgacatccgggcaacgcctctgttctgtcctcccccttcgtcgcctgtgacaaccggaagcggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaa

SEQ ID NO: 561 - DNA, 1750 bp, Homo sapiens
tcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtcctgctgaactgtaaattctaccatctccactttgcagatgaggaaattgagactttgacaagtcaaagagcacagctggaatgcaagtcaaatatgtacaaggatatccacaacactgttcgcagctacaagctgaggtacaaggtgcctcaaaagcttgagagaagcagaaatagaatagaatcctgacctgtgaaaacaatgactctgcaataaggtgcagagttggctggatcactataatatcctagggccaggcgcagtggctcacgcctgtaatcccagcactttgggaggccgaggtgggtggatcacgaggtcaggagatcaagaccatcctggctaacacggtgaaaccccatctctactaaaagtacaaaaaattagctgggtatggtggcgggcacctgtagccccagctactccgaaggctgaggcaggagaatggcgtgaacccaggaggcagagcttgcagtgagctgagatcgtgccactgcactccagcctgggcaacagtgcaagactccatctcaaaaaaaaaaaagcactataatatctaagaaatttggtttgtgtttattagtaaatatgctagatcatcaaagatttaatctagaccttaaaatttgaggtttccgtaggctttattattatatgatacctaatgtttaactgatattttaagccatgtaaacaaagaatacttctgaatgtttcactaaatttcttgagtttttttttttaacttaacctcactaggcctcaatattcagaatgtgaaacaggggagttggattggtgattgctgatatttttttccagctgtaaaataaaggcaatgggtccatttaa

SEQ ID NO: 562 - DNA, 582 bp, Homo sapiens
agagtctgggtcctccgagaacaaggacgaatgtagatcatggaaggacctgaaaagtactgtttctcgctatcttagctttagctaagtaaccttcaaggcgcgagaaagacataggactccgattccttgcctctgaagaatgaatcctctttcaaagtttcagctaaccatgagatggcgctgtgaccaaagacgaaagcggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaa

SEQ ID NO: 563 - DNA, 2446 bp, Homo sapiens
acaaaaaccctgactatcacctgatagattgcttgtgctgcctgataattactcgcacttttcccaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggtccagtgtgagaccctagaagacctgaaaattcatctccagactactgattatggtaactttttggctaatcacacaaatcctcttactgtttccaaaattgacactgagatgaggaaaagactatgtggagaatttgagtatttccggaatcattccctggagcccctcagcacatttctcacctatatgacgtgcagttatatgatagacaatgtgattctgctgatgaatggtgcattgcagaaaaaatctgtgaaagaaattctggggaagtgccaccccttgggccgtttcacagaaatggaagctgtcaacattgcagagacaccttcagatctctttaatgccattctgatcgaaacgccattagctccattcttccaagactgcatgtctgaaaatgctctagatgaactgaatattgaattgctacgcaataaactatacaagtcttaccttgaggcattctataaattctgtaagaatcatggtgatgtcacagcagaagttatgtgtcccattcttgagtttgaggccgacagacgtgcttttatcatcactcttaactcctttggcactgaattgagcaaagaagaccgagagaccctctatccaaccttcggcaaactctatcctgaggggttgcggctgttggctcaagcagaagactttgaccagatgaagaacgtagcggatcattacggagtatacaaacctttatttgaagctgtaggtggcagtgggggaaagacattggaggacgtgttttacgagcgtgaggtacaaatgaatgtgctggcattcaacagacagttccactacggtgtgttttatgcatatgtaaagctgaaggaacaggaaattagaaatattgtgtggatagcagaatgtatttcacagaggcatcgaactaaaatcaacagttacattccaattttataacccaagtaaggttctcaaatgtagaaaattataaatgttaaaaggaagttattgaagaaaataaaagaaattatgttatattatctagactacacaaaagtaagccacactatatcttcatgagttgcaaatccatggaaacacagtaaaccagccctgaaacaaagcatttccttgttttcagtggtattagatcttgtttccacatgtctgtctcattcttcactgggccttacaggttagttttaattaactctatggtatttttcttattcttgtttgatcatgttaaaaattggacctaataaaagtattttattcttgcttttccatgcttctctacaggtccaaatactgaatgtctcctttactttttctcttttaaatttttttctagacagggtctcactctgtcacctaggctacagtgcagtggtgtgatcacagctcactgcagcctcgacttcccaggctcaagtgatcctcccagctctcagcctccaaagtagctggcactacaagtgtacacccccacacaaggctaagttttgtattttttgtagagacagggtttcaacatattatccaggctggtgtcgaattcctgggctccagggatccacagtcccccttggcctcccaaagtgttgggattacatgcatgagccactgtgctgggcttcatttacattttaactgtctgttccttgcctagattcacagaaatccaaagctgtatgtagtcaacatggttcacaagtgttggaaaatgtgttttttgttttgttttgttttgtttcgttttgttttgagacagagtttccctctgtcgcccaggctagagtgcaatggcgtgatctcggctcactgcaacctccacctcccagattcaagcaactctctgcctcagcctcccgagtagctgggattacaagcacccaccactacactcagctaattttttgtatttttagtagagccggggtttcaccatcttggccaggctgatcttgaactcctgagctcatgatccacccgcctcagcctcccaaagtgctgggattacaggccccttgttcagccactgcacctggccccttattttgtttttgttttctaatatactttgatgtaatcagcttgagaaagcaacacaatttcaaatcctatcttctagatgcaagcagtgttaaatttgttaataaatttgcttttcacacctttctttaaataaaaggtatatctctcttt

SEQ ID NO: 564 - DNA, 448 bp, Homo sapiens
aacctgggatgagatcctcgtttcagaaaatgatttgatcctcctgaaggcgctccctgctaaggatctaaactcaggagacgggatttcaccatgtttgccaggctggtcttgaactcctgacctgaagtgatctgcccacctcagcctcccaaagtgttgggattacagagcatctctcagggattcttaaaataaaataagtcactgtgaatacacaaaggaaatgaaaacatatacagagtgtgaaataacagccaaaaaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctg

SEQ ID NO: 565 - DNA, 504 bp, Homo sapiens
taaaatcacagataaaataagttcctatggtgaggaatggaggcctccagctgacagagagcaaagaactgaggcctgcgacaactataggcgtgatcctgggaaccgattctcaacctcatctgagccttgagacgactgctgctctggccgacagcctgacggcaacctcctgagacagctctgagaggagattttccaggttcaagtcccgagacgaggtttcaccgtgctggccaagctggtctccacctcaggtgatctgccccgctaagcctccgcaagtgctgggattacaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggtccagtgtgagaccctagaag

SEQ ID NO: 566 - DNA, 1565 bp, Homo sapiens
agccggcagagcgctccggccccgcacccgccgcccgtcgcccgcagccccctaccgcgcggcccgcgccccgccggctcccgtcactgggtaagagaagactggaagcatgtcggagttttggttaatttctgcccctggcgataaggaaaatttgcaagctctggagaggatgaatactgtaacctccaagtccaacctgtcttataataccaaattcgctattcctgacttcaaggtggggaccttggattccctggttggcctctctgatgagttggggaaactcgacacctttgctgaaagcctcataaggagaatggctcagagcgtggtggaagtcatggaggactcaaaggggaaggtccaggagcacctcctggcaaacggagttgacttaacatcctttgtgacccactttgaatgggacatggccaaatatcctgtcaagcagccgctcgtgagtgtggtggacacaatagccaagcaactggcgcagatcgagatggacctgaagtcccgaacggccgcctacaacactctgaagacaaacctggagaacctggaaaagaaatccatggggaacctcttcacccggacactgagtgatattgtgagcaaagaggacttcgtgctggattctgaatatctcgtcacacttctggtcatcgtccccaaaccaaactactcacaatggcaaaaaacctacgaatctctctcagacatggtggtccctcgatcaaccaaactcattactgaggacaaggaagggggccttttcactgtgactctgtttcgaaaagtgattgaagatttcaaaaccaaggccaaagaaaacaagttcactgttcgtgaattttactatgatgagaaggaaattgaaagggaaagggaggagatggccagattgctgtctgataagaagcaacagtatcaaacttcctgtgttgctcttaaaaagggatcatccaccttcccggaccacaaggttaaggtaaccccgctaggtaaccctgataggcctgctgcggggcagaccgacagagagagagagagtgagggcgagggtgagggccccctgctgcgctggctcaaggtgaacttcagtgaagccttcattgcctggatccacatcaaggccctgagagtgtttgtggagtccgtgctcaggtatggactaccagtgaacttccaggcagtgctcctgcagccgcataagaagtcatccaccaagcgtttaagagaggttctaaactctgtcttccgacatctggatgaagtagccgctacaagtatactggatgcatctgtggagatcccgggactgcaactcaataaccaagactattttccttatgtctacttccatattgaccttagtcttcttgactagaaaggccagctggcacctctgtctcatgttcgtgcagattattacagacacctctttcctttagccagagaatggttcaaatgtcttacagaactaagatctttttcagagaaattgctcacaaaagttagtgacagttgtatttatttttttaagttacaataaaatgctc

SEQ ID NO: 567 - DNA, 3102 bp, Homo sapiens
agccggcagagcgctccggccccgcacccgccgcccgtcgcccgcagccccctaccgcgcggcccgcgccccgccggctcccgtcactgggtaagagaagactggaagcatgtcggagttttggttaatttctgcccctggcgataaggaaaatttgcaagctctggagaggatgaatactgtaacctccaagtccaacctgtcttataataccaaattcgctattcctgacttcaaggtggggaccttggattccctggttggcctctctgatgagttggggaaactcgacacctttgctgaaagcctcataaggagaatggctcagagcgtggtggaagtcatggaggactcaaaggggaaggtccaggagcacctcctggcaaacggagttgacttaacatcctttgtgacccactttgaatgggacatggccaaatatcctgtcaagcagccgctcgtgagtgtggtggacacaatagccaagcaactggcgcagatcgagatggacctgaagtcccgaacggccgcctacaacactctgaagacaaacctggagaacctggaaaagaaatccatggggaacctcttcacccggacactgagtgatattgtgagcaaagaggacttcgtgctggattctgaatatctcgtcacacttctggtcatcgtccccaaaccaaactactcacaatggcaaaaaacctacgaatctctctcagacatggtggtccctcgatcaaccaaactcattactgaggacaaggaagggggccttttcactgtgactctgtttcgaaaagtgattgaagatttcaaaaccaaggccaaagaaaacaagttcactgttcgtgaattttactatgatgagaaggaaattgaaagggaaagggaggagatggccagattgctgtctgataagaagcaacagtatggccccctgctgcgctggctcaaggtgaacttcagtgaagccttcattgcctggatccacatcaaggccctgagagtgtttgtggagtccgtgctcaggtatggactaccagtgaacttccaggcagtgctcctgcagccgcataagaagtcatccaccaagcgtttaagagaggttctaaactctgtcttccgacatctggatgaagtagccgctacaagtatactggatgcatctgtggagatcccgggactgcaactcaataaccaagactattttccttatgtctacttccatattgaccttagtcttcttgactagaaaggccagctggcacctctgtctcatgttcgtgcagattattacagacacctctttcctttagccagagaatggttcaaatgtcttacagaactaagatctttttcagagaaattgctcacaaaagttagtgacagttgtatttatttttttaagttacaataaaatgctctcaagtcctttgaatgttccaacaaattcaaaacttcattttctgaatgttttacataaatgcgaactacctgttcgcattggtaacctgctgctgtatttcatgtcttaacggctattttgaggttcattaacaacatagaaagccttgaactgtataaccagctagattccttaataattagtcactagagacagcccaaagacaaatattgggcaggaaatcagttctcactgagcccggtttccatgtaaaatctctgttgtggtgggcataggtggcaccatctaaagaaaagaggtcttgttttttgtttaaaaaagtttgtggggaggaaagacatctgtgtatcacttcaaaatattgatttactgctaaacatcactctgaatttatgatgtggatactaacttcatacatttatcggcattgtccaaaatattttattctttaatggaaaaagccattaatattcaaatgaagggatcacattaaaaaaaacccatacataagaaacagcctccaagaacattcaagcagcagtcagagagaaaaatgtttcgacagccaagttttcttcaaaatattatgtgacagaatacgactcaattcaccggctacaacaattcatagaatttttcaatgttttcttgagatgcaaaagttcactgttgcagtgttttcaaatgaccaatcaagtactacttcttggttaaaaggccactggtagagtcatctgagtgtagagaatgtcccttcactgctggaaaaatccactggctcccaagaaaagaaaatggtctgaagcctctgttgtggctctcacaactcatctttccctaagtcatcaagctccacatcactgaggtcaatgtcatcctccacgggaagctgggagacgacagaaagccactgttagatctgcagaaggggacaccctggaaggtcaacatctcattttatggaagagcgactctctggagctactcctgctacaatccaggttctcctcagtctgactcctaccctgaccttcgtacctatgattatacggatggaaaagctcagaactcaggtgaaacatttcaacatcacatcactcaccattttaacactggaagccacttgaacgtgtccttttgaggagggtgggacacaacagtacagaaataagtgctaatttcaaagctatcattttctatttttctaagataaagtaaatgaattccaggttaaatgttcactttaaggtaataatcaggaaagcaaccttactactgaaatgtatcttggctgtcaagagtatcaaatgccatgcagcacttaaacttgtgataaggaagatgaagggtcttcagagaagaacctcttaaaaggcccacgggtgcaccagggctgaggtctgatgggaaggacttgactccaggtgcagagatgcacaggctcaagagagtaaaccaggactgctgcccgcacagcttccctcccgggcactcacctcgccatccctgccgtcccaaggctctctctcaacgatggtagggaaagccccgcctcctacaggtgccgtggagccacgcccaaaagagagctcccttagggaaaaatgaccaaaacacacacacacatttacaatggactgctggtgcagaagaataaacaactttaaaaataa

SEQ ID NO: 568 - DNA, 2365 bp, Homo sapiens
agctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaaacatggcctctctctttacttggactttgaacaaaagtcaactgttgtctcttttcaaaccaaattgggagaattgttgcaaagtagtgaatggcaaataaatgttttaaaatc

SEQ ID NO: 569 - DNA, 2007 bp, Homo sapiens
gcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactcc

SEQ ID NO: 570 - DNA, 1892 bp, Homo sapiens
attcgcgaggtaaggccgccctcgcgttgtttggtctcaggctgcagaccaggtcaggcgactcttgcagtttctccagcttgcctggtgcgtgctggtgtctcgccgcttggtcctctcctgttcttcggcccccggttgccagattgcttttcttccaggcctcaaccagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgc

SEQ ID NO: 571 - DNA, 403 bp, Homo sapiens
gttgtttggtctcaggctgcagaccaggtcaggcgactcttgcagtttctccagcttgcctgatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcag

SEQ ID NO: 572 - DNA, 735 bp, Homo sapiens
agattgcttttcttccaggcctcaaccaggtttattaagcgaaattctggagcctttctcgcagggggaagaaacgtcaggggcgggcaggagagtggagggggaggggtaaaaagtataccttctccaggactgggccacggccctggatcgctgggggtgcgagtagttcagggacttaggtaattgtctagagacaccttgagctacgccaggacgggccgctgaggctgagcctccttggctgcagagttccagcctggcccagttgaagcctgttttttcctgggccctgtcgttcgcgctgcccagggttgtttatacagcaaatcttcagatacagagattaagttccaaattgattaagatcgttggaaacccggaatataattttggatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgc

SEQ ID NO: 573 - DNA, 1891 bp, Homo sapiens
agctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcgggccgcgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccac

SEQ ID NO: 574 - DNA, 1805 bp, Homo sapiens
ctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcgggccgcgtggaggatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaa

SEQ ID NO: 575 - DNA, 1847 bp, Homo sapiens
agagctgccaccagcagcaggctcagacactgggctcccaggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcgggccgcgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagatg

SEQ ID NO: 576 - DNA, 2875 bp, Homo sapiens
gcggcgtcgctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatggaccttaactaaa

SEQ ID NO: 577 - DNA, 1808 bp, Homo sapiens
gggccagtcgggacagaggagacaagatggcgctgcgggcgatgcgggggattgtcaacgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagt

SEQ ID NO: 578 - DNA, 4591 bp, Homo sapiens
cccccccccaacctgtgcagctgaggacttcccctccgtggtgacagcctctgggtcctcggtcggtacagtctctgcacctcgcgccccagcaggtaaactaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttctatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaa

SEQ ID NO: 579 - DNA, 754 bp, Homo sapiens
ccctccgtggtgacagcctctgggtcctcggtcggtacagtctctgcacctcgcgccccagcaggtgagcggcgaccggtaaactaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctg

SEQ ID NO: 580 - DNA, 2266 bp, Homo sapiens
agctgaggacttcccctccgtggtgacagcctctgggtcctcggtcggtacagtctctgcacctcgcgccccagcaggtaaactaacattatggatttttccaagctacccaaaatactcgatgaagataaagaaagcacatttggttatgtgcatggggtctcaggacctgccttcactccatgtatcatagcaactctcagaacatacctgaatcctaccagtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttg

SEQ ID NO: 581 - DNA, 1525 bp, Homo sapiens
gctttaactcttgctgtccacattttccacattgtactttataacatactctttgtgaaaatttatcttttatttctttaatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaa

SEQ ID NO: 582 - DNA, 502 bp, Homo sapiens
ggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtgactatgcttgtgacctttcttatcagtatggtcaggcagtcagagtttgccttgactttttctcacattttatggccattttaacacgtggcaagggcaagctgctgaatgcaaacacgatctgaagagcagaaataaaattggaacttaagccttagcttacctaaatctcattaagattcttttt

SEQ ID NO: 583 - DNA, 1433 bp, Homo sapiens
gggaggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaagacaaacaagactccagtggggtggtcagtaggagagcacgttcagagggaagagccatctcaacagaatcgcaccaaactatactttcaggatgaatttcttctttctgccatcttttggaataaatattttcctcctttctatggaaatctgggctcggtgtttgtaaagttcatttttataagcttttctatcgctacataatgcctttttaaaaaatgattttgtagtctaaacttaggttgagtatataaaccctgccatgtagcttgagatgcctgaaaagactggtaagtgcgtttcttaatcgttcagtaactatttgagtgcctactgcagccaaggcactggagggatcaaagatgtgtaaatttggagtccctgcaagttcacaagctatttggagagataaggttagtatacatagaactgtaatataaggttgtgttggagcattgtccttaaagatggtaccatggtgagcagttcaaggttacctgccagctgcagaacaaggcagcaaatgctcctgagatggaaccatcacagcctcagacataggactaaagaagtcaagagtgattaaaaagccaggggcaggagacagtaattttgtatttcagtagcaggcatctcgatacactaatttgagagctttattacttttaagaaattaaaaattaaaatgaacctaaattttca

SEQ ID NO: 584 - DNA, 2099 bp, Homo sapiens
gggggcaacggtcacctgatctgcggctgtcgaggccgctgaggcagtggaggctgaggctatgatggcggccatggcgacggctcgagtgcggatggggccgcgatgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 585 - DNA, 867 bp, Homo sapiens
acctgatctgcggctgtcgaggccgctgaggcagtggaggctgaggctatgatggcggccatggcgacggctcgagtgcggatggggccgcgatgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggttcattctggccaaccgcctctacccagtgtctgcccggcactggtttaccatggagcgcctcgaagtccacagcaatggctccgtcgcctacttcaatgcttcc

SEQ ID NO: 586 - DNA, 1478 bp, Homo sapiens
gctgaggcagtggaggctgaggctatgatggcggccatggcgacggctcgagtgcggatggggccgcgatgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagttt

SEQ ID NO: 587 - DNA, 720 bp, Homo sapiens
gaggccgctgaggcagtggaggctgaggctatgatggcggccatggcgacggctcgagtgcggatggggccgcgatgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacagatgaggtcatcgggcaggtcctgagcacactcaagtccgaagatgtcccatacacagcggccctcacagcggtccgcccttccagggtggcccgtgat

SEQ ID NO: 588 - DNA, 2106 bp, Homo sapiens
taaattaaataattaaatagatgatttttacatactgtagagctatagagaaaatatagctggatgggtgatagtgacttggggatgggggtggctactctggatagggtagtttaaggtgacatctctgtgcagatgtagaatgggctagtgctttctaagaactgaaagatcagtgaagaaggggagcatagtgactgaggagtagtgtggcattagatggggtctgagagttacacaggaacatgtggagcctgtaggccatggtaaagcctttttctactcttctggtgatttaaagccattgtaaagttttgagcttgggagtaggtagcaaaataagatttatatttttatggggttactctggctgttgagaggagaaaaagacatgaatctgggaggccacttgggaagcaaggccatcagtgaagagaaagagtgggagaaaaaggtttgaggagagaaggtataggactttcactaaccttggaccatatatttgccaggaagaatgtaagttctccaacatcttcaaataaagaagtggttatgaggaatgatcagaataatggagatatgaaaccattccagaatttcacaacaataccaatcacacaggctctcaactacaatctgagcaaagaagggcatttagaaaaagaaccttggaatgcattcagccatcatggcccagttaatgtctccatcaatggaattccttgcattctcttctgggccaaaagaataatgattaaatttaagaatcaaacctggctggaccttacagacgagccatttggtcagaaggtaactgtggaccctgacaactcaaattgcagtgaagaaagtgctagaaaaaaaaagtaggctcctttgtataggaccctgacacacatctttgaggaagtatttactgtctaaaataaaggaacaagtcagaagttaacttcaaaaattgttggctgggcatggtggctcacgcctgtaatcccagcacttcgggaggccaagggagtggatcacctgaggtcaggagttggagacaagcctggccaacatggtgaaacctcgtctctactaaaatacaaaaattagccgggcgtggtggcaggtgcctgtaatcccagctactcaggaggctgagacaggagaattgcttgaacctgggaggtggaggttgtggtgagctgagatcgcgccattgctctccagcttgggtgacagagtgagtgagactccatctcaaaaaaaaaaaattgttatattttcccggcagttttcttctgaacctttttgctaattgtcggaataacttgtagaaaatgagactttggaaagcaagggttctcaaactcgttttgaaaacagcaaaggattccaggcttggtctcaactccaaatggttgtctttgaagcttggtgatgctggaaaccccagaagtcttgctataagattcatccttaccaattacaacaagttgtccatccagagttggtttagtttgcgccgagtcgagatcatttccaacaattcaatccaagcagtctttaacccaactggcgtatatgctccctctggttactcctaccgctgccaacgcgtgggcagcctgcagcaggaccaggccctcttgctgcccagcgacacggatgatgggtcgagcctgtgggaggtcacttttattgatttccagatccaaggttttgccatcaaggggggacgatttaccaaagcccaagactgcgcctcctccttctcgccagcttttctgatcggcctggcaatgtccctgatcctgctgctggtgttggcctatgccctgcacatgctcatctacctgcggtatctggaccaacaatatgatctcatcgcctctcctgcccacttctcgcagctgaaagctcgagacacagccgaagagaaggagctgctgaggagccagggggctgaatgctataaactgagaagccaacagatcagcaaaatctatgtttagcagcacaggctggcccccaccatgtccacagtgggctccgaaagttgtctctgttctgtgctatttgacttgtgaattacagattttcaccaaatggcttgattac

SEQ ID NO: 589 - DNA, 758 bp, Homo sapiens
tcccggcagttttcttctgaacctttttgctaattgtcggaataacttgtagaaaatgagactttggaaagcaagggttctcaaactcgttttgaaaacagcaaaggattccaggcttggtctcaactccaaatggttgtctttgaagcttggtgatgctggaaaccccagaagtcttgctataagattcatccttaccaattacaacaagttgtccatccagagttggtttagtttgcgccgagtcgagatcatttccaacaattcaatccaagcagtctttaacccaactggcgtatatgctccctctggttactcctaccgctgccaacgcgtgggcagcctgcagcaggaccaggccctcttgctgcccagcgacacggatgatgggtcgagcctgtgggaggtcacttttattgatttccagatccaaggttttgccatcaaggggggacgatttaccaaagcccaagactgcgcctcctccttctcgccagcttttctgatcggcctggcaatgtccctgatcctgctgctggtgttggcctatgccctgcacatgctcatctacctgcggtatctggaccaacaatatgatctcatcgcctctcctgcccacttctcgcagctgaaagctcgagacacagccgaagagaaggagctgctgaggagccagggggctgaatgctataaactgagaagccaacagatcagcaaaatctatgtttagcagcacaggctggcccccaccatgtcca

SEQ ID NO: 590 - DNA, 3868 bp, Homo sapiens
ctccagaactctcacccgattgcctgcctctgctgcgtctttgcccactgaacagccatgagaaggcaactccggtccagaagggctccatcctttccttacagttatcgctacagactcgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggtcagagttggagcctgatcttactcatttacttcttcttctatgcctccttggctgctgtgatcaccctctgcatgtacacactatttctgaccatcagtccctatataccaaccttcacggagcgggtaaagcctcctggagttatgatcagacccttcgcccatagccttaacttcaacttcaacgtttctgaacccgacacttggcagcattatgtgattagcctaaatggctttctccagggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccggattgtaggctttcgtcctgagcttggagatcctgtgaaggtttcctgcaaagttcagagaggtgatgaaaatgacatccgatccatcagttactacccagagtcggcttcttttgacctccgctactacccttactacggcaaactgactcacgttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttaccagttctgtttctgttttatctcatggtatctctggtagcacctgaattctttttcttcaattaggacacagccagatggacatctaagacagccgatcatctttccttgcctatgacatgtgtataaaatgacattgtgggagctgttcgattttttaaaggtagtgtctcctgatgacaaacagagtatattaatttcctttccctccacttaaaactaaagcctgttcttgctgctggtaatctccctgtagcgtaaacatagtatctgataaaatttacaatagccacgcaatagccatcaaggagaatttctattatgattataaattcatcatgttttctaaaattctgttggttttagaggtcagattcctcccaaccaggctaataacctaacacatgtttaaaaaaaatctgcctaagccgggtgtggtggcatgcatctgtagtcccacctattcaggagattaaggcaggaggatcacttgagcccaggaggtcaaggctgcagtgagctgcactgcattccagcctgggtgacagagtgagatcctgtctctgaagaaaaaaaaaacctgcctggcaaggtccttccctgggaatcaccactcggtccaacctagacaaccaagaccgctatacctaaagacctctatatcctggtgcctaagaaacttctgcctcccacagacaactaagtgcttattcaaagactaggttattttcaactgggaaaaaagcagtgctaacaggatattgttctgggatagagatgaagaccgtccttgtgactttttaaagaggtggggctcactgcaactggggagaacacttagcatatggatatgattggtgtttgattccttgctctctggtgtaatcgtctaaaggcaaacattcctgcaaacaggtttttctcagcttcaggcagaggagacaacatggaagaagattcccaccagctaattcttcttgggctatttgtttgacagtagcatgatgttttttgagaccatcaggggtggttacatagaccagcagctacagctctggaaattgaaatcataatctgtcaatgaatacatgacaagacagaacgttccttgccaggccaggcaaaagccaaggcccattagccagtttagcatttactttaaaaatgacatgaggcagattcttatccaggatgtggatcagccaggtcactttgtcttatctttggtcacctgatcactcaactgcttcttaacacctccaccagggggaaggctggcacaaggagaaaaaaaaagcaagcatcagcgaatagtatagtgtctcagggtccgaagcaagtttaaatgccacctaggaggatccaaagtctgaatctcctctacaatgtttcctttctcccaaaacagggaactgactgtctggtagtgaagacaagcaagtggagaagttatacgatatagtttaatgagagttaaaaaactagtatgtggaaagctatgggaatatgaggaaaaatatcttgagctaagaaagtagcagaggaaatttcacatgcaaagccacagtcatgaagagaccatggtgtgtctgggtaactgtgagcagtttatgtaactggaatgaaaagggctcagaggaatggcagggatggcaagagatccagctagagaggtattcagggatggaaagaggactttgagttttatccaataggtgaaaatgagtaattaaagcattttaatcagggaggctctgtgatcacatttgtgttttattttattttactttattatttatttgtttatttttgagatggagtttcgctgttgtcacccaggctggagtgcagtggtgtgatctcggctcactgcaacctccacctcccggattcaagtgattctccagcctcagcctcctgagtagctgggattacaggcacacaccaccatgcccagctaacttttgtatttttggcggagacagggtttcaccatgttggccaggctggtctcgaactcctgacctcaagtgatccgcctgcctcagcctcccacagtgctgggattacaggcgtgagccaccgcacccggcttgcaatttagaaagggcacttggcaaccactatgtgaagggtgattggagaaggacaagactgtggaatggggaataaggaaggaggagtttggagaatgactccaaaggtttgagcttggctagaaccggtaagatggtgacattgttgatcaagactgggaatataagagagaagcaggtttggagagatcaattttgaacattttagacatgattttctattggtcagacattgatgtggagatgtaaacacatgtagggttggtgagaaggaaagatgagaacaaaagcaacattgggttaagggaactcgcttaagaaattttaagctatttaatcttgggaactgaagccagtcatgtaaacatactataccaatctagtccctaacagtgttttttctcttgtggcagaaagaattgctgttcctctttggaatctccttcccagacaccttcaaagtcttattgacacagtaaagggaggccaaccactactaacaagttctagaagatataggatcttctatagtaggttaatggaaaatacaaaaacaaacaaacatacaatgaaactgcctcctctcaacccattttcttaacaaattcaattttcaaaa

SEQ ID NO: 591 - DNA, 3856 bp, Homo sapiens
ctccagaactctcacccgattgcctgcctctgctgcgtctttgcccactgaacagccatgagaaggcaactccggtccagaagggctccatcctttccttacagttatcgctacagactcgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggcctgatcttactcatttacttcttcttctatgcctccttggctgctgtgatcaccctctgcatgtacacactatttctgaccatcagtccctatataccaaccttcacggagcgggtaaagcctcctggagttatgatcagacccttcgcccatagccttaacttcaacttcaacgtttctgaacccgacacttggcagcattatgtgattagcctaaatggctttctccagggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccggattgtaggctttcgtcctgagcttggagatcctgtgaaggtttcctgcaaagttcagagaggtgatgaaaatgacatccgatccatcagttactacccagagtcggcttcttttgacctccgctactacccttactacggcaaactgactcacgttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttaccagttctgtttctgttttatctcatggtatctctggtagcacctgaattctttttcttcaattaggacacagccagatggacatctaagacagccgatcatctttccttgcctatgacatgtgtataaaatgacattgtgggagctgttcgattttttaaaggtagtgtctcctgatgacaaacagagtatattaatttcctttccctccacttaaaactaaagcctgttcttgctgctggtaatctccctgtagcgtaaacatagtatctgataaaatttacaatagccacgcaatagccatcaaggagaatttctattatgattataaattcatcatgttttctaaaattctgttggttttagaggtcagattcctcccaaccaggctaataacctaacacatgtttaaaaaaaatctgcctaagccgggtgtggtggcatgcatctgtagtcccacctattcaggagattaaggcaggaggatcacttgagcccaggaggtcaaggctgcagtgagctgcactgcattccagcctgggtgacagagtgagatcctgtctctgaagaaaaaaaaaacctgcctggcaaggtccttccctgggaatcaccactcggtccaacctagacaaccaagaccgctatacctaaagacctctatatcctggtgcctaagaaacttctgcctcccacagacaactaagtgcttattcaaagactaggttattttcaactgggaaaaaagcagtgctaacaggatattgttctgggatagagatgaagaccgtccttgtgactttttaaagaggtggggctcactgcaactggggagaacacttagcatatggatatgattggtgtttgattccttgctctctggtgtaatcgtctaaaggcaaacattcctgcaaacaggtttttctcagcttcaggcagaggagacaacatggaagaagattcccaccagctaattcttcttgggctatttgtttgacagtagcatgatgttttttgagaccatcaggggtggttacatagaccagcagctacagctctggaaattgaaatcataatctgtcaatgaatacatgacaagacagaacgttccttgccaggccaggcaaaagccaaggcccattagccagtttagcatttactttaaaaatgacatgaggcagattcttatccaggatgtggatcagccaggtcactttgtcttatctttggtcacctgatcactcaactgcttcttaacacctccaccagggggaaggctggcacaaggagaaaaaaaaagcaagcatcagcgaatagtatagtgtctcagggtccgaagcaagtttaaatgccacctaggaggatccaaagtctgaatctcctctacaatgtttcctttctcccaaaacagggaactgactgtctggtagtgaagacaagcaagtggagaagttatacgatatagtttaatgagagttaaaaaactagtatgtggaaagctatgggaatatgaggaaaaatatcttgagctaagaaagtagcagaggaaatttcacatgcaaagccacagtcatgaagagaccatggtgtgtctgggtaactgtgagcagtttatgtaactggaatgaaaagggctcagaggaatggcagggatggcaagagatccagctagagaggtattcagggatggaaagaggactttgagttttatccaataggtgaaaatgagtaattaaagcattttaatcagggaggctctgtgatcacatttgtgttttattttattttactttattatttatttgtttatttttgagatggagtttcgctgttgtcacccaggctggagtgcagtggtgtgatctcggctcactgcaacctccacctcccggattcaagtgattctccagcctcagcctcctgagtagctgggattacaggcacacaccaccatgcccagctaacttttgtatttttggcggagacagggtttcaccatgttggccaggctggtctcgaactcctgacctcaagtgatccgcctgcctcagcctcccacagtgctgggattacaggcgtgagccaccgcacccggcttgcaatttagaaagggcacttggcaaccactatgtgaagggtgattggagaaggacaagactgtggaatggggaataaggaaggaggagtttggagaatgactccaaaggtttgagcttggctagaaccggtaagatggtgacattgttgatcaagactgggaatataagagagaagcaggtttggagagatcaattttgaacattttagacatgattttctattggtcagacattgatgtggagatgtaaacacatgtagggttggtgagaaggaaagatgagaacaaaagcaacattgggttaagggaactcgcttaagaaattttaagctatttaatcttgggaactgaagccagtcatgtaaacatactataccaatctagtccctaacagtgttttttctcttgtggcagaaagaattgctgttcctctttggaatctccttcccagacaccttcaaagtcttattgacacagtaaagggaggccaaccactactaacaagttctagaagatataggatcttctatagtaggttaatggaaaatacaaaaacaaacaaacatacaatgaaactgcctcctctcaacccattttcttaacaaattcaattttcaaaa

SEQ ID NO: 592 - DNA, 997 bp, Homo sapiens
tgctgcgtctttgcccactgaacagccatgagaaggcaactccggtccagaagggctccatcctttccttacagttatcgctacagactcgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggtcagagttggagagttatgatcagacccttcgcccatagccttaacttcaacttcaacgtttctgaacccgacacttggcagcattatgtgattagcctaaatggctttctccagggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccggattgtaggctttcgtcctgagcttggagatcctgtgaaggtttcctgcaaagttcagagaggtgatgaaaatgacatccgatccatcagttactacccagagtcggcttcttttgacctccgctactacccttactacggcaaactgactcacgttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttacca

SEQ ID NO: 593 - DNA, 1483 bp, Homo sapiens
attgcttctcggccttttggctaagatcaagtgtaatctgtgttcttttttatttggtcatatcttccattctttcttacctaattcctctaatatctctctgtgagcctaaaccaataattatatattacattctattgtctttcttatataactgcagaaagataaatatcactttgtttgttcctgtaggttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaagaaaaaataatacaacaaagacgtattgataatctaccacactatctacgttgaggtatctggaaccacagtggtatgaattgcactatctccctaatctttacactaattctggctaaaagacagcatcagctcaaattttcctgatcagttttttagcaggctttggctgccaaaatctcttctgtgttttaagtctgaagcaattacagttgaatattttgttgttgttcactatgaggagtatatcggttttaggtcacaggaatgatctagtagagatgtatttttctagtacacttgatagtaccttgaatatgtacagtacatgtaggcccattttatggacctctgaggcacagttttttcctttttaagttattagatatttctgtgatttatttgatgcactcagatacaaattcatgctataataagttaaattgtaacataatatctaccttaatcaaatatttatagtttaggccaggagcctggcaaagtaaagatgacacagatgaaatgcttgataagtaaataaatatgagaagagatatatattaaaa

SEQ ID NO: 594 - DNA, 2906 bp, Homo sapiens
cctaattcctctaatatctctctgtgagcctaaaccaataattatatattacattctattgtctttcttatataactgcagaaagataaatatcactttgtttgttcctgtaggttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaaggcgagcaaaggtcggactacaatcgtggtagcacaccgactttctactattcgaagtgcagatttgattgtgaccctaaaggatggaatgctggcggagaaaggagcacatgctgaactaatggcaaaacgaggtctatattattcacttgtgatgtcacaggatattaaaaaagctgatgaacagatggagtcaatgacatattctactgaaagaaagaccaactcacttcctctgcactctgtgaagagcatcaagtcagacttcattgacaaggctgaggaatccacccaatctaaagagataagtcttcctgaagtctctctattaaaaattttaaagttaaacaagcctgaatggccttttgtggttctggggacattggcttctgttctaaatggaactgttcatccagtattttccatcatctttgcaaaaattataaccatgtttggaaataatgataaaaccacattaaagcatgatgcagaaatttattccatgatattcgtcattttgggtgttatttgctttgtcagttatttcatgcagggattattttacggcagagcaggggaaattttaacgatgagattaagacacttggccttcaaagccatgttatatcaggatattgcctggtttgatgaaaaggaaaacagcacaggaggcttgacaacaatattagccatagatatagcacaaattcaaggagcaacaggttccaggattggcgtcttaacacaaaatgcaactaacatgggactttcagttatcatttcctttatatatggatgggagatgacattcctgattctgagtattgctccagtacttgccgtgacaggaatgattgaaaccgcagcaatgactggatttgccaacaaagataagcaagaacttaagcatgctggaaagatagcaactgaagctttggagaatatacgtactatagtgtcattaacaagggaaaaagccttcgagcaaatgtatgaagagatgcttcagactcaacacagaaatacctcgaagaaagcacagattattggaagctgttatgcattcagccatgcctttatatattttgcctatgcggcagggtttcgatttggagcctatttaattcaagctggacgaatgaccccagagggcatgttcatagtttttactgcaattgcatatggagctatggccatcggagaaacgctcgttttggctcctgaatattccaaagccaaatcgggggctgcgcatctgtttgccttgttggaaaagaaaccaaatatagacagccgcagtcaagaagggaaaaagccagacacatgtgaagggaatttagagtttcgagaagtctctttcttctatccatgtcgcccagatgttttcatcctccgtggcttatccctcagtattgagcgaggaaagacagtagcatttgtggggagcagcggctgtgggaaaagcacttctgttcaacttctgcagagactttatgaccccgtgcaaggacaagtgctgtttgatggtgtggatgcaaaagaattgaatgtacagtggctccgttcccaaatagcaatcgttcctcaagagcctgtgctcttcaactgcagcattgctgagaacatcgcctatggtgacaacagccgtgtggtgccattagatgagatcaaagaagccgcaaatgcagcaaatatccattcttttattgaaggtctccctgagaaatacaacacacaagttggactgaaaggagcacagctttctggcggccagaaacaaagactagctattgcaagggctcttctccaaaaacccaaaattttattgttggatgaggccacttcagccctcgataatgacagtgagaaggtggttcagcatgcccttgataaagccaggacgggaaggacatgcctagtggtcactcacaggctctctgcaattcagaacgcagatttgatagtggttctgcacaatggaaagataaaggaacaaggaactcatcaagagctcctgagaaatcgagacatatattttaagttagtgaatgcacagtcagtgcagtga

SEQ ID NO: 595 - DNA, 5811 bp, Homo sapiens
aaattataaaagttgtcctaaaaattggttcagtgccttttacaatcgtatgtaccttatctctctctccatttctgcatgaacagtccatcctatccaaaccgttctcatttctctaccatgagataattcaccttgcattcctaaaactatgcccttgttcctcctccacatttttctacttactgaaaccttagccttcctccagaaactaacctcagggccatcctcatctgtgggcgaaaccattttagatcacaatgttcttcctcagtcttcttagatactagaatagtcactctttgtactattcatcacataacgtctgtcttgccaggtatattaggttcccctagagaaatagaatcaataggccgtgtgtgtgtgtgtgtgtgtgtgtgtgtgtgtgtgtgtatgtagagagagaaagagaaaacacgctcatgtaattgtggtgactggcacttccaaaatccacaagccagactagaaggctggaaattctggcaaaaaattgataccttgtatctgaaagctttatcctatcctcttcagaagacttcagtcttttctcttaaggacttcaactgactggatggggcccactcaaaacagcatctaaggaattaaaaagaagtaaattgtaaataagatggaaaattcagaaagagctgaagaaatgcaagaaaattatcagagaaatggaactgcagaagaacagccaaaactgagaaaggaagcagttggatctattgagatattccgctttgctgatggactggacatcacactcatgatcctgggtatactggcatcactggtcaatggagcctgccttcctttaatgccactggttttaggagaaatgagtgataaccttattagtggatgtctagtccaaactaacacaacaaattatcagaactgtactcagtctcaagagaagctgaatgaagatatgactctgttgaccctgtattatgttggaataggtgttgctgccttgatttttggttacatacagatttccttgtggattataactgcagcacgacagaccaagaggattcgaaaacagttttttcattcagttttggcacaggacatcggctggtttgatagctgtgacatcggtgaacttaacactcgcatgacagatgacattgacaaaatcagtgatggtattggagataagattgctctgttgtttcaaaacatgtctactttttcgattggcctggcagttggtttggtgaagggctggaaactcaccctagtgactctatccacgtctcctcttataatggcttcagcggcagcatgttctaggatggtcatctcattgaccagtaaggaattaagtgcctattccaaagctggggctgtggcagaagaagtcttgtcatcaatccgaacagtcatagcctttagggcccaggagaaagaacttcaaaggtatacacagaatctcaaagatgcaaaggattttggcataaaaaggactatagcttcaaaagtgtctcttggtgctgtgtacttctttatgaatggaacctatggacttgctttttggtatggaacctccttgattcttaatggagaacctggatataccatcgggactgttcttgctgttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaaggcgagcaaaggtcggactacaatcgtggtagcacaccgactttctactattcgaagtgcagatttgattgtgaccctaaaggatggaatgctggcggagaaaggagcacatgctgaactaatggcaaaacgaggtctatattattcacttgtgatgtcacaggatattaaaaaagctgatgaacagatggagtcaatgacatattctactgaaagaaagaccaactcacttcctctgcactctgtgaagagcatcaagtcagacttcattgacaaggctgaggaatccacccaatctaaagagataagtcttcctgaagtctctctattaaaaattttaaagttaaacaagcctgaatggccttttgtggttctggggacattggcttctgttctaaatggaactgttcatccagtattttccatcatctttgcaaaaattataaccatgtttggaaataatgataaaaccacattaaagcatgatgcagaaatttattccatgatattcgtcattttgggtgttatttgctttgtcagttatttcatgcagggattattttacggcagagcaggggaaattttaacgatgagattaagacacttggccttcaaagccatgttatatcaggatattgcctggtttgatgaaaaggaaaacagcacaggaggcttgacaacaatattagccatagatatagcacaaattcaaggagcaacaggttccaggattggcgtcttaacacaaaatgcaactaacatgggactttcagttatcatttcctttatatatggatgggagatgacattcctgattctgagtattgctccagtacttgccgtgacaggaatgattgaaaccgcagcaatgactggatttgccaacaaagataagcaagaacttaagcatgctggaaagatagcaactgaagctttggagaatatacgtactatagtgtcattaacaagggaaaaagccttcgagcaaatgtatgaagagatgcttcagactcaacacagaaatacctcgaagaaagcacagattattggaagctgttatgcattcagccatgcctttatatattttgcctatgcggcagggtttcgatttggagcctatttaattcaagctggacgaatgaccccagagggcatgttcatagtttttactgcaattgcatatggagctatggccatcggagaaacgctcgttttggctcctgaatattccaaagccaaatcgggggctgcgcatctgtttgccttgttggaaaagaaaccaaatatagacagccgcagtcaagaagggaaaaagccagacacatgtgaagggaatttagagtttcgagaagtctctttcttctatccatgtcgcccagatgttttcatcctccgtggcttatccctcagtattgagcgaggaaagacagtagcatttgtggggagcagcggctgtgggaaaagcacttctgttcaacttctgcagagactttatgaccccgtgcaaggacaagtgctgtttgatggtgtggatgcaaaagaattgaatgtacagtggctccgttcccaaatagcaatcgttcctcaagagcctgtgctcttcaactgcagcattgctgagaacatcgcctatggtgacaacagccgtgtggtgccattagatgagatcaaagaagccgcaaatgcagcaaatatccattcttttattgaaggtctccctgagaaatacaacacacaagttggactgaaaggagcacagctttctggcggccagaaacaaagactagctattgcaagggctcttctccaaaaacccaaaattttattgttggatgaggccacttcagccctcgataatgacagtgagaaggtggttcagcatgcccttgataaagccaggacgggaaggacatgcctagtggtcactcacaggctctctgcaattcagaacgcagatttgatagtggttctgcacaatggaaagataaaggaacaaggaactcatcaagagctcctgagaaatcgagacatatattttaagttagtgaatgcacagtcagtgcagtgatgctgttgaggtagcacatattttgatgttcgtgtaatgcaaagaaggagtacttaataattacttggcaagctttgatctcttttattgcatatatcaatacctagaatcatgctactcaagtacatacatgttctattcacacaccatctgaccttcagatttttaaaaggaagcaaaaatttgcttatttcatgtaagtgaaataatgcttatatccttcactttataaaactattctagcacatttgcttgtaaagcagttttctacaaggtgaatttatttcccatcaacttctgctataaaatcggaaatatgtttccagggggaatattatccaattaaccatgttgaaggttttagcaaaggcagtgtaagatagagtggggcctgtagcattgcagggagagtgtctttcacttggaattttgttttgcagcacatattacagtagttttgctagtcccttttctccagaccgtagggatttctctcaataagtattcactatttctctaaattttattctatttttttgttgagcagggaatagaaaggattacgatgtaaaatttctgggaggattaggtagctatctcctacttcaccagtaagtgaagtgcctcacatgagccatcccaaagattcattattccaaaccttgggtttggcagtataagtcacaggcctacctgtttatgaaaacttacttacttaaaataagagctacttttgggccgggtgcggtggctcacgcctgtaatcccagaactttgggaggccgaggagggcggatcacttgaggtcaggagttcgagaccagcctggccaacatggtgaaaccccgtctctactaaaaacacaaaaattagccaatcttggtggcgggcacctggaatcccagctacttgggaggctgaggcaggagaatcatttgaacctaggaggcagaggttgcagtgagccgagatctcaccactgcactccagcctgcgcaacagagcgagactccatctcaaaaaataataaataagagctaattttattgtgggtgaaaatttttaaacgtctttctctataataaaataatttccttaaattttatatatactttatcatatataatgtgtgaatgattttaaagttctgtgtaaataacaatattggtaaaatgagttacattttcaacttacttaaatatgtaatgtcacctggtgattttatctttattcttcagtgtattttcttccatttacacatttagctagcctccctaaagtgtactctaccaataattgaaatcttgttaaacaaaattaaaaccatttatatattatgctgctttctttaaaatgcaaaataaaaataagattggggacttgag

SEQ ID NO: 596 - DNA, 2247 bp, Homo sapiens
attgcttctcggccttttggctaagatcaagtgtaatctgtgttcttttttatttggtcatatcttccattctttcttacctaattcctctaatatctctctgtgagcctaaaccaataattatatattacattctattgtctttcttatataactgcagaaagataaatatcactttgtttgttcctgtaggttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaaggatacccccaggtattcattttgacctaatttcacctcaagtggagaatcgctgaccttgaaccagcgcccttcgacagctctggcccctcaaacctcaccctgacctcctgctgcctatgagctactgcacatacctcaaggccatatgcagttgtggccctgcaccaaattacactgaatctaggaggggagttggcagtggcggtatgaaaaaccattgaacagttttctcgatggcctgactcccttataaaccagagccttcagaccccttacaaggcttaatggcacattttactttgcatttgcttggaagtgagttaagcgtttttttttctctaagaaaatcgcaggcttctttttttaaaatgctgactttatggaaccagaaacggatactggcaggctaaatgtccactgcttcttgaaaaatctcttagttactattatttagtagcaaatcagattgtgcaagtttgaacgcttgtttccctcccataataacaatgccacatgttgcttgtgtgataaataatctttgtttactgtggacacttcggcaatttggttcatcttggtacagaaaatacaaagacaggactaatattttattcattttttatacttagtaactaggacagggatctgtatttagactatattcaagcctcgctctgtcacccatgcttgagtgcaacctctgcccactgtgttcaagcgattctcctgcctcagcctcctgagtagctgggagtacaggcgtgcatcaccacacccagctaatttttgtatttttagtagagacaaggttttgccatgttgaccaggctggtctcaaactcctgacctcaggtgatccgcccacctcggcctcccaaagtgctgggattacaggtgtgcgtctccgcgcccggccagttacataagattttaaaaaatgtattgtaataggctctctgattgtttagaaggtttcatgttgtgcccgcagtattttcatccactggtaatcactttaggtaatcaaaactagttcagacttttaaaataaatagttgcttggtgacatgataaactaataaatgttattcttattggttaatatgaaacatctatcaaaagtgaaaaaagaagaatgcagaatgtttgtaaactgattccaaaattacacaaaatagcaactgtgaaaaaaatgaaggcaatatatgaaaataataacagctatgtggcataattatgggggaatttaacttatttcaaaaattcatttactgtccctgtttttcagttgtttaaaggagaaagagattaaatcaatgtagaaata

SEQ ID NO: 597 - DNA, 4981 bp, Homo sapiens
cggggcccggggggcgggggcctgacggccgggccgggcggcggagctgcaagggacagaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcaccatcgctgatcccaaagaactggccagaccaagggaagatccagatccagaacctgagcgtgcgctacgacagctccctgaagccggtgctgaagcacgtcaatgccctcatcgcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttccta

SEQ ID NO: 598 - DNA, 4848 bp, Homo sapiens
cggggcccggggggcgggggcctgacggccgggccgggcggcggagctgcaagggacagaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcaccatcgctgatcccaaagaactggccagaccaagggaagatccagatccagaacctgagcgtgcgctacgacagctccctgaagccggtgctgaagcacgtcaatgccctcatcgcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttccta

SEQ ID NO: 599 - DNA, 4921 bp, Homo sapiens
agaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcaccatcgctgatcccaaagaactggccagaccaagggaagatccagatccagaacctgagcgtgcgctacgacagctccctgaagccggtgctgaagcacgtcaatgccctcatcgcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttccta

SEQ ID NO: 600 - DNA, 4283 bp, Homo sapiens
gcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaagcacgtcaatgccctcatcgcccctggacagaaggtcagagcacgggcccaacccaatgctgcaggacaggcgtgagcaggggatggggcatgcacggagctggatggcttcgcagtcacctcgtggccctccagggcc

SEQ ID NO: 601 - DNA, 1582 bp, Homo sapiens
ctcttctccggcaggatcgcggccgagcagtctgcccagagacttagcgacagacagacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgttccccactcttcaaagccaagatgagaaaccaaaatatattagagagaccctagagacttactggcccaacagagagttgcttcttgatttcatagcaaggattgaaaaatgacttggagaaaggatagttttttacctggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccaagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccgggggcacaacaaggcaatagcatttaaaaggaaaggcggcagtggcatggaggctccagagactgagcccttcctacggcaagaagggagccagtggcgcccactgctgaaggccatctggcaggtgttccattctaccttcctcctggggaccctcagcctcgtcatcagtgatgtcttcaggttcactgtccccaagctgctcagccttttcctggagtttattggtgatcccaagcctccagcctggaagggctacctcctcgccgtgctgatgttcctctcggcctgcctgcaaacgctgtttgagcagcagaacatgtacaggctcaaggtgctgtagatgaggctgcggtcggccatcactggcctggtgtacagaaaggcatccacagcatatctgaagaaatattcagaagttaactaatctcagatgatttcagcaggagtaaagaagagaaacagactcagaaatgccattacaacagttaattatgtcaaatttatcaccctgattgatcacgcagcattaacctcaagaacgccaagccaagtttttttgacaaatgtgagccaaggtttccga

SEQ ID NO: 602 - DNA, 798 bp, Homo sapiens
tttgagccgcgtcgaggtcgggcttgggaagggtcagcgggaggcctgagggcgccgggcgctgcggcaggcgggcccggggtccagccgagaggctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcct

SEQ ID NO: 603 - DNA, 1047 bp, Homo sapiens
ggaatccggcccctgggtggtccggaaacgattctggacctgcgggtatatccagggcccgcaccccctgggattgtgggaaatgtagttttttgcctccgtaagggaccaggcggagctgaggaaccgcgcgaggactgggaccgtgattccactaaccggaaaccgtcgcctttcgggcccggcggggcctgagccaatgcagaatcgggggccgcgaggacgccagcgggcgctgtgcgtaggaaccgccgggtggccgctgccgatcggggccgacttggggacggaccggaagtgcccgagggcggccgcagaacggtcaatttgagccgcgtcgagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccttt

SEQ ID NO: 604 - DNA, 1072 bp, Homo sapiens
cgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcggtgcgtccgagcgcgacaccgcccgcgtcgggggcttgggagcctcggggcgcgagctgtgttggaagcaaagtcctccttgtgggttggggtggcggagggagaagggaagcgagggtcgcggcgggaccagacgccccagtcccggcccgcccgcgactactgaaggcgctgccgcctgacctgaacgggcacttgtgttccagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccttt

SEQ ID NO: 605 - DNA, 875 bp, Homo sapiens
tcaatttgagccgcgtcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactc

SEQ ID NO: 606 - DNA, 3213 bp, Homo sapiens
gtctttctgttcactttttttcacaaaatcatccaggctcttcctactctcctctcttaccacctctctcttcttttttttttttttttagttatttcacagatgccactggggtaggtaaactgacccaactctgcagcactcagaagacgaagcaaagccttctacttgagcagtttttccatcactgatatgtgcaggaaatgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacagatgtaaaaagtgcctcagaacgaccctccaaggacgaaatggcaagcagaccctggctcctgtatcgtttacttcctttggggggattgcctctactcatcactacctgtttctgcctgttctgctgcctgagaaggcaccaaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaagtctgtttctgactccaacagggaccattgaatgatcagcatgttgacatcattgtctgggctcaacaggatgtcaaataatatttctcaatttgagaatttttactttagaaatgttcatgttagtgcttgggtcttaagggtccataggataaatgattaaaatttctctcagaaacttatttgggagctttttatattatagccttgaataacaaaatctctccaaaactggttgacatcatgagtagcagaatagtagaacgtttaaacttagctacattttacccaatatacaaactcgatcttgcctttgaagctattggaaagacttgtagggaaaagaggtttgtgttacctgcatcagttcactacacactcttgaaaacaaaatgtcccaatttgactaaccaaccataaatacagtaatgattgtatatttcaagtcagtcttccaaaataagaaatttttgctgtgtcagtctaagaatggtgtttcttaaatgcaaaggagaaatcattttaggcttgatgtaagaaaatgaaaataataaatggtgcaataaaaatatagaatataccaattggatatagggtagatgttccacatacctggcaaacaaatgcttatatctactctgttagattgataagcaaatataggtattaatggagcagtcaacgtatagcacatttatgaggaaagtagagactcactgggtcacatagactaatggataggaatgtgacataatgctgctgaattaatatacttatgggcatctgaatagtttaaaagttagtcagaataggtatcactgggcaagtgaagatagcttaaactgcttcatgcttgacttgatagcaagttaaagtgcaattaatggaatggaggaaaacccagaatatttaattggtctgtaggggtcaatttgctttcattcaccacatctgcatcttgctgttcttcttactaaggaatcagggcaaatcatctgtagtgacatattttagtttgctaatcatttattttaaaatactgaggttgcagccacttaagagtatagcaaaagatggattcagatttttggactttccaaagtacttgagttaaactatttcaaaaatagcctataattttattcaacagtttgaggctattcgaattctcaggtgctgctactgaataatgtaatagtcttcatacaaagtggatagcaaaggttaaaatccatttcaacaaatatgtgagctgagctgctgcacaaaggaatgtgatgtgtgtgtgtgtgtgtgtgtgtgtgtgtgttaggtggggtgggtgacaacagaaatggtgcacgagaaactgatcaaattgacattatattttcagtttgcttatgaagctcaaaatactagagtaaatgggtcattaaagaaaataatatgtgaaattatggagtttagaatacaagtggggtatatatacaaaaagacaaaactgaggttttgtggtggagagattttcttaagtaacactggcattaagttttagctccttagatttgggggtgcaaatattcttttgagtcactgttattttgccaattacacctagaatttcaagcaaccaattcgagataggctgttttagccaggctgcatttgtggacaacttatgtaagaaagacatgttagaatagctgcttgtggtattcttaaaaatagaaacaggaaatatggggaggatacatttagctgtcctcttatcagatgaacacacgaaattgaacagttccttcatgattctctcaaacttaaaagcaaaatatttctgtcttatttaaaatatccttagtatgtcttatagtaaagataatgctgataatgatttcatctctaagatgtattaatatatttgtactgtttgccaaaatcacaaatcatttatgtttttattccttttcaaaatggtgtcagagacatacatgcattttcccaaatgactctacttcactattatttacatggcttatttcattagtttatagagggtttgagaaaaagaatatgtagataatttaatggtttttcacaaattttaagcttgtgattgtgctcaatgagaaggtaaagttattaaaacttatttgaaatc

SEQ ID NO: 607 - DNA, 726 bp, Homo sapiens
atgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaa

SEQ ID NO: 608 - DNA, 6438 bp, Homo sapiens
aaagtgcggcgcgggtggggctggtcacgcgcctggcttcctgcagtgcgaacctgggaaatccaggcgacttcgcagttgccgaagggatctgaagaagtgggatgtgcaaaagcgccggctggaaatcccggctgtgtctccgtcaactctttacgcaacagaggtctccccctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtggcttccccagccagcagattgttgctggatcaagtgggcatgaaagagaatgaagacaaatatatgtgtgagtcaagtgggttctacccagaggctattaatataacatgggagaagcagacccagaagtttccccatcccatagagatttctgaggatgtcatcactggtcccaccatcaagaatatggatggcacatttaatgtcactagctgcttgaagctgaactcctctcaggaagaccctgggactgtctaccagtgtgtggtacggcatgcgtccttgcatacccccttgaggagcaactttaccctgactgctgctcggcacagtctttctgaaactgagaagacagataatttttccattcattggtggcctatttcattcattggtgttggactggttttattaattgttttgattccttggaaaaagatatgtaacaaatcatcttcagcctatactcctctcaagtgcattctgaaacactggaactcctttgacactcagactctgaagaaagagcacctcatattcttttgcactcgggcatggccgtcttaccagctgcaggatggggaggcttggcctcctgagggaagtgttaatattaatactattcaacaactagatgttttctgcagacaggagggcaaatggtccgaggttccttatgtgcaagccttctttgccttgcgagacaacccagatctttgtcagtgttgtagaattgaccctgctctcctaacagttacatcaggcaagtccatagatgataattccacaaagtctgagaaacaaacccctagggaacactcggatgcagttccggatgccccaatccttcctgtctcccctatctgggaacctcctccagccacaacatcaacaactccagttctatcctcccaacccccaactttactgttacccctacagtaaatgcctgatggacctggtgccactagggtccaagttcccttttcattacaggaccttgggcaaataagaggggacctgggcaagttctctgatgacctgatagatatatagaggctttccaaaacctaactcaggtgtttgaccttacttggggtgatgttatgttgctcttaaactcttaactactacagagaaacaggtagccctgcaggcagcagaaaaattcagagatgaacaacatgtcttctatagccactcaataaggaaagaaggtgagaaacaaccagcattcacatacccaataggaagcgaggcagtgccccttgaacaacataattcggaccccagtggtaccttagatgagtggcaaagaaaacattttcaaatgtgcttattagagggcctacagaggaccagagccaagcctcttaattaccccaaactctccatgatagatcaaaaactagatgaaaatccctcagcctttttggaaaggctgagagaggctgtagtgaaacacacttccttgtctcctgttaggtatgtttatacctcacataaataattcaattgagggacagctaattttgaaagacaagtttattactcagacagcccctgatatcagaaggaagctagagaaacaggccatgggattagatagcaccttacaaaacctcctgaaggtagccacctcggtcttttataatagggaccaggaggaggcccaggggaaggagaggaaacacaagaaaaaggcagagactctggtggccactttgtataaaacccagtatccccaaggtacacctgctagttgctaccaatgtggcaaactagggcacttcaaaagggactgcccaggcagcaagaagaagccacctcaaccctgtccagtatacaatggggaccactggaaggcagactgtcctgggaagcataggtcactgagtccagagccagtctcacaaatggtccagcaggactgatgggtcctggggctcaactccctggctccagtggctcagactgctgttactacccgggagcaccaggtgattctggagttcgaagggaggaaggtagacttctttctggacactggagccaggcttctgttttcctctccaattcaggccttcgttcctcccatagcacaaccatgatgggcatctcaggaaagactttaacttgatatttttctcaacctattagttgcagtcagagggacctactgtttacacaggcctttttagtcatgcctgaaagtcccactcctttattagatagagatattccagcacgtatgggggccaccatccttatggctccaggacaaactccgcctccccttagtggaaaccagtattaacccagaggtttgggcaactcagggaagaagtggccggactataaccactataccagtctggatccacctcaaggatcccactttttttcctaaccagagacaataccctctgaagccagaaagtagaaaagggctagacgccagcattgataacctaaaggcacaaggcctccttaggccttgcagtagcccttgaaacaccccaatattaggggtgcaaaaatccaatggggaagggagactagttcaggacctctgccttattcatgaggctgtgattacgattcatccagtagatcccagtccctatactttgctaactcaaatatccaagggaactaaatggttcacagttctgggcctaaaggatgcctttttctgtatacctttataccctgactcccaatacttgtttacctttgaagacccctccaatcaaaccacccagttaacctggactgtactgcctcagggatttagagatagcccccacctatttgggcaagtattgtcaagagatctcttcgaattcttccattctcaggttaaagttttacaatatgtagatgacattctcctctgtgccccaactgaggaagtttcttgagacggcactgaggctctccttaatttcctagctggaaagggatataaggcttcaaaatctaaggctcagctctatcagactttggtaaattacctaggtctggtcttgtcagaagggaacaagagcactaggcgaggagaggattaatcccatttcctcccttcctctccccagaaccctcaagcagctgagggatgcttgggcattacaggtttttgtaggttatagatacccaggtatgataaaataggttgccctttatatcaccttataaaagaaattcaagtggctaaaactcacttcctgacctgggaacctgaaggtcaaaaggccattaatcagttaaaacaagccttgcttaaagcaccagcccccagtctttctgtagggaagtcctttaatctttatgtatcataaaggaaaggaatgaccctgggagttttaattcaagttcaaggcccagctcaacagccagtaggttacttaagtagagagcttgacttggaggctaaaggatggccagcttgcctctgagcagttacagtagtggccctgctagtcccagaggccaccaagttaaccctggggaataacctgtttatgcctcacataaataatgtggcaggcttgctgtcctctaaagcgagtctctggctaacagacagctgcctcctcaagtatcagactttgctgctagaggaatctgcagtccagttaaaaacctgaccttgcctgatcccagacactttcctcccagaggaaactggagaaactgaacataattgtgaacagactgtagtacaacctatgccgctagggaggatctcaaagaaattcccctagaaaatccagactggacccactttatggatgggagctcttttgtaggacagggagtctgaaaagtgggatatgcagtagtcaccctaaataacattgaaaatgtgcctctctcaccaggcacacacactcaatcagttgagctgatccctctcacaagagcacttgaactaagcaaaggaaagacagctaacatttatactgactccaagtgtacctttctagttctccttgcccatgctgccatctgaaaggaaaggcacttcctcaccgctaatgggtcttgcattaaataccatcaagacatcaacaggctattatcctcagtgttcctcccatgagaattagtggtcagacattgcagagggcatcagaagcgggtagatgaaatagcgaaaggaaacaggctagcagaccaaagagctaagtcagcagtaagaaggccccaaggtcccaaaacacttgaggcccctctgatttgggagggctacataagggaaataaagcctcagtattcccctacagagatagaatgggccacctctcgaggtatacttttcaaccctcaggatggttacaatcagaagattgcaaagtacgcttgccagcctccagccaatggaagattcttaaaatcctccactgagcctttcacttaggaaagcataagacatcagtgcatccaaagattgttctcaggagaaaatctactaaaaatggtcaaataggttgttaatactcgtgaaaccctcttaaaaataatccctttaacagatgacttcttccccaccacaatcaaaggatgggaagttactcaggggaggactggcagatagacttcacccatatgcccaaaataaatggcattcaatgtcttttggtgtgggtgcataccttcattaactgggtagaggcattcccatgcccaacagaaaaggcctctgaggtggtgagaatactaattagttaaataattcctcactttgggctccctaagtacttccaaaacaacaatggtccctcatttaaagaagcctctacccagtagggccgagtctgctaggactttttattgggtttggtaatacgtcacaccctttagcctctactgtgtcagccatgtcccatttatacaagacaaattgctgggtctgtcctgagcggtttgctcagttcagtaacactaaggaacctcttgatgacttggtatttactgtcttagcattccctttgttagctttacctttagccattaaagacttgtcaggcataaatggaacatggtatgggaacactttcaactgagtaactaactcctcccaggaaagcatttcctccctggtgccagaaaacactttccccaaagataagcctcacaccctcaggctaggaaaagttggccgggtaatagcaaatgcctcctcctgttttaaaagcagaggaaaaggaccatacctgggagatctcaaatattataacaccatacttgtaattgctgaaagctcggaagtttggagaaaaagacataagaaggatgatctaagaaaattggaagccatatggaggggaggctttcagaattcagcgtctcctcctggttgaaagtcctgctgggaatggcaggctctgggtaaccaccctgacacatggcactataatgtaaaaaacaacacataggccttcccagacatgcaccctcatgggattccagaccccctgtatgatgcttagtagtagtggcctacaaatctgtgggtgaacagaacaggagacttctggactgacagcccctgtcacaagggggcattatctgagatattggccagggcatatcgtgtccctggtcttttgaaactccatttgtcggccaggtgtggtggcttacgactgtaatcccagcactttgggaggctgaggcaggtagatgatgaggtcaggagttcaagactagcctggacaatatggtgaaaccccgtctgtactaataatacaaaaaaaaaaaaaaaaaaa

SEQ ID NO: 609 - DNA, 2429 bp, Homo sapiens
cctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtggcttccccagccagcagattgttgctggatcaagtgggcatgaaagagaatgaagacaaatatatgtgtgagtcaagtgggttctacccagaggctattaatataacatgggagaagcagacccagaagtttccccatcccatagagatttctgaggatgtcatcactggtcccaccatcaagaatatggatggcacatttaatgtcactagctgcttgaagctgaactcctctcaggaagaccctgggactgtctaccagtgtgtggtacggcatgcgtccttgcatacccccttgaggagcaactttaccctgactgctgctcggcacagtctttctgaaactgagaagacagataatttttccattcattggtggcctatttcattcattggtgttggactggttttattaattgttttgattccttggaaaaagatatgtaacaaatcatcttcagcctatactcctctcaagtgcattctgaaacactggaactcctttgacactcagactctgaagaaagagcacctcatattcttttgcactcgggcatggccgtcttaccagctgcaggatggggaggcttggcctcctgagggaagtgttaatattaatactattcaacaactagatgttttctgcagacaggagggcaaatggtccgaggttccttatgtgcaagccttctttgccttgcgagacaacccagatctttgtcagtgttgtagaattgaccctgctctcctaacagttacatcaggcaagtccatagatgataattccacaaagtctgagaaacaaacccctagggaacactcggatgcagttccggatgccccaatccttcctgtctcccctatctgggaacctcctccagccacaacatcaacaactccagttctatcctcccaacccccaactttactgttacccctacagtaaatgcctgatggacctggtgccactagggtccaagttcccttttcattacaggaccttgggcaaataagaggggacctgggcaagttctctgatgacctgatagatatatagaggctttccaaaacctaactcaggtgtttgaccttacttggggtgatgttatgttgctcttaaactcttaactactacagagaaacaggtagccctgcaggcagcagaaaaattcagagatgaacaacatgtcttctatagccactcaataaggaaagaaggtgagaaacaaccagcattcacatacccaataggaagcgaggcagtgccccttgaacaacataattcggaccccagtggtaccttagatgagtggcaaagaaaacattttcaaatgtgcttattagagggcctacagaggaccagagccaagcctcttaattaccccaaactctccatgatagatcaaaaactagatgaaaatccctcagcctttttggaaaggctgagagaggctgtagtgaaacacacttccttgtctcctgttaggtatgtttatacctcacataaataattcaattgagggacagctaattttgaaagacaagtttattactcagacagcccctgatatcagaaggaagctagagaaacaggccatgggattagatagcaccttacaaaacctcctgaaggtagccacctcggtcttttataatagggaccaggaggaggcccaggggaaggagaggaaacacaagaaaaaggcagagactctggtggccactttgtataaaacccagtatccccaaggtacacctgctagttgctaccaatgtggcaaactagggcacttcaaaagggactgcccaggcagcaagaagaagccacctcaaccctgtccagtatacaatggggaccactggaaggcagactgtcctgggaagcataggtcactgagtccagagccagcttctgttttcctctccaattcaggccttc

SEQ ID NO: 610 - DNA, 804 bp, Homo sapiens
caggcctccatctccaggtccctctccgaggcttcctcgctgccagctgagtcgtgggcacctgagggactacctaccactgctcccggctgtgccatcgccaccagctcccagcctcctgctcagacccgggacagcccctccatggcccccgagatggaccagttttacaggtccaccatggccatctacaagagcatcatggagcagtttaaccccgccctggagaacctggtgtacctgggcaacaactacctgcgtgccttccacgctctgtccgaggcggccgaggtctacttcagtgccatccagaagattggggagcgtgccctgcagagccccacctcacagattctgggggagatcttggtgcagatgtctgacacccagcggcacttgaactctgacctggaggtggtggtgcagacattccatggaggcctgctgcagcacatggagaagaacaccaagctggacatgcagttcatcaaagacagccgccagcactatgagctcgagtaccgccaccgagcggccaacctggagaagtgcatgtctgagctgtggcgcatggagcgcaagagagacaagaacgtgcgggagatgaaggagagtgtgaaccggctgcacgcacagatgcaggccttcgtgtctgagagtcagcgggcggctgaattggaagagaagcggcgctatcgcttcctagcagagaagcacctgctactttccaacaccttcctgcagttcttcggccggatgttagctgatggacgcctggttgtttccactctttggctgtcatga

SEQ ID NO: 611 - DNA, 2146 bp, Homo sapiens
gcaggcctccatctccaggtccctctccgaggcttcctcgctgccagctgagtcgtgggcacctgagggactacctaccactgctcccggctgtgccatcgccaccagctcccagcctcctgctcagacccgggacagcccctccatggcccccgagatggaccagttttacaggtccaccatggccatctacaagagcatcatggagcagtttaaccccgccctggagaacctggtgtacctgggcaacaactacctgcgtgccttccacgctctgtccgaggcggccgaggtctacttcagtgccatccagaagattggggagcgtgccctgcagagccccacctcacagattctgggggagatcttggtgcagatgtctgacacccagcggcacttgaactctgacctggaggtggtggtgcagacattccatggaggcctgctgcagcacatggagaagaacaccaagctggacatgcagttcatcaaagacagccgccagcactatgagctcgagtaccgccaccgagcggccaacctggagaagtgcatgtctgagctgtggcgcatggagcgcaagagagacaagaacgtgcgggagatgaaggagagtgtgaaccggctgcacgcacagatgcaggccttcgtgtctgagagtcagcgggcggctgaattggaagagaagcggcgctatcgcttcctagcagagaagcacctgctactttccaacaccttcctgcagttcttcggccgggcccgggggatgctccagaaccgcgtgctgctgtggaaggagcagtctgaggccagccgcagcccgtcgcgcgcccactcccccggcctgctgggccccgcgctggggccgccctacccctcgggccgcctgacgcccacctgcctggacatgcccccgaggcccctgggagagttcagctccccccgcagccggcacggctccggctcctacggcaccgagcccgacgcgaggcccgcgtcccagctagagccagaccgtcgctccctgccccgcacgccgtcggcctcctcgctctacagcggcagcgcccaaagctcgcgctccaactcctttggcgagcgcccgggcggcggcgggggcgccaggagagtccgcgccctggtctcccactcggagggcgccaaccacacgctgctgcgcttctccgctggggacgtggtggaggtgttggtgcccgaggcccagaacggctggctctacggcaagctggagggctcgtccgcgagcggttggttccccgaggcgtacgtgaaggctctggaggaggggcccgtgaatcccatgacccccgtgacccccatgacctccatgacctccatgtcccccatgacacccatgaaccccgggaacgagctgccttccaggtcctacccactccggggcagccacagcctcgatgacctcctggaccggccgggcaactccatagcaccctcggagtactgggatggccagtcccgctcccgcaccccaagccgggtgccaagccgtgcccccagccctgcacctccacccttgcccagcagccgccgcagcagcatgggcagcacagcagttgccactgacgtcaagaaactgatgtcctcagagcagtacccaccacaggagctcttcccgaggggcacaaatccttttgccactgtcaagcttcgtcccaccatcaccaatgaccgctcagcacccctcatccgctgaggcggggtccgaggtcgtaccccacagtgcacctgcccaggggctgttcagagctggcaatggcagcgacagcagcaacagcagcagatccaagaagcgggtccctgagacggggggtggctgccctccccagaccaccccggcagcctgagcagctccaaagcactggcttggggtccgagaccttcaaagtaaagcaggcggaatggggggacaggacaatttctccccctccaggggctccaggactctccctggggggcccacctcttgccccctaacctctttcccccttttctgcccccgtggggaggagccccttgtacctgctccgtgcccaacacatgccctctctgtacatcttttgtaaatgatgagaaataaaggaagtggacgcaaagtgatgcggca

SEQ ID NO: 612 - DNA, 2102 bp, Homo sapiens
caggcctccatctccaggtccctctccgaggcttcctcgctgccagctgagtcgtgggcacctgagggactacctaccactgctcccggctgtgccatcgccaccagctcccagcctcctgctcagacccgggacagcccctccatggcccccgagatggaccagttttacaggtccaccatggccatctacaagagcatcatggagcagtttaaccccgccctggagaacctggtgtacctgggcaacaactacctgcgtgccttccacgctctgtccgaggcggccgaggtctacttcagtgccatccagaagattggggagcgtgccctgcagagccccacctcacagattctgggggagatcttggtgcagatgtctgacacccagcggcacttgaactctgacctggaggtggtggtgcagacattccatggaggcctgctgcagcacatggagaagaacaccaagctggacatgcagttcatcaaagacagccgccagcactatgagctcgagtaccgccaccgagcggccaacctggagaagtgcatgtctgagctgtggcgcatggagcgcaagagagacaagaacgtgcgggagatgaaggagagtgtgaaccggctgcacgcacagatgcaggccttcgtgtctgagagtcagcgggcggctgaattggaagagaagcggcgctatcgcttcctagcagagaagcacctgctactttccaacaccttcctgcagttcttcggccgggcccgggggatgctccagaaccgcgtgctgctgtggaaggagcagtctgaggccagccgcagcccgtcgcgcgcccactcccccggcctgctgggccccgcgctggggccgccctacccctcgggccgcctgacgcccacctgcctggacatgcccccgaggcccctgggagagttcagctccccccgcagccggcacggctccggctcctacggcaccgagcccgacgcgaggcccgcgtcccagctagagccagaccgtcgctccctgccccgcacgccgtcggcctcctcgctctacagcggcagcgcccaaagctcgcgctccaactcctttggcgagcgcccgggcggcggcgggggcgccaggagagtccgcgccctggtctcccactcggagggcgccaaccacacgctgctgcgcttctccgctggggacgtggtggaggtgttggtgcccgaggcccagaacggctggctctacggcaagctggagggctcgtccgcgagcggttggttccccgaggcgtacgtgaaggctctggaggaggggcccgtgaatcccatgacccccgtgacccccatgacctccatgacctccatgtcccccatgacacccatgaaccccgggaacgagctgccttccaggtcctacccactccggggcagccacagcctcgatgacctcctggaccggccgggcaactccaccccaagccgggtgccaagccgtgcccccagccctgcacctccacccttgcccagcagccgccgcagcagcatgggcagcacagcagttgccactgacgtcaagaaactgatgtcctcagagcagtacccaccacaggagctcttcccgaggggcacaaatccttttgccactgtcaagcttcgtcccaccatcaccaatgaccgctcagcacccctcatccgctgaggcggggtccgaggtcgtaccccacagtgcacctgcccaggggctgttcagagctggcaatggcagcgacagcagcaacagcagcagatccaagaagcgggtccctgagacggggggtggctgccctccccagaccaccccggcagcctgagcagctccaaagcactggcttggggtccgagaccttcaaagtaaagcaggcggaatggggggacaggacaatttctccccctccaggggctccaggactctccctggggggcccacctcttgccccctaacctctttcccccttttctgcccccgtggggaggagccccttgtacctgctccgtgcccaacacatgccctctctgtacatcttttgtaaatgatgagaaataaaggaagtggacgcaaagtgatgcggc

SEQ ID NO: 613 - DNA, 4572 bp, Homo sapiens
agacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccggctgtggctccagagtctgtgccctttaccaccgtgcccaactgtttcacatgctgtgtttggtagtttttcctagtactctccttaataatggtggtgtttagcaaattgtattacataaataaatatttatttcatggattgagttatgttgcatattaaattactttccttcccattgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttctggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctctgtgggctggttcagttctgcattcccattccagtgtccactgccttctcgctatccctcccatctgtgcgccaccaccagcttatccccagccctgctaacatgacaaactattgtgcatttgagtgcccactatacaatgtgtgaatataaccgtgcttttaagcattgactttaatgtctgggatgatccgtctagagtccatggaaccctcctgtgttttttcatccctttcttagtaatcttggaaatccacttatgaaattctttttctaacatttctttgctgaacggcatttttaaaattactttcacggtgtttctttccagtttgatctctacacaaacacaactttattacttgcaccagaaatgatttcaaacactttaggaactgtggtaggcttaattatgacttcccaaaagatatccctataccaatccctggaacctggaaatgttctcttctatagcaaaagatatgattaagttaaagtcttgagatggagagattattctgggtaatctgggagtgccctaaatgcagctacatctatgcttatatagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagcta

SEQ ID NO: 614 - DNA, 1946 bp, Homo sapiens
gagcgggagggccgggaagccgggcgttggtggagggaggcgttgggcttctgtcgccgcgaagctggcggaaaaggcagtggccagcgagccgcctcgccagttcccacgactcccagggaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaa

SEQ ID NO: 615 - DNA, 5773 bp, Homo sapiens
gtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagcattccagttttggtgaatttttaagcaaaagaagccacaaaaatggcagcattggaaaacagactggttctagaaaaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccggctgtggctccagagtctgtgccctttaccaccgtgcccaactgtttcacatgctgtgtttggtagtttttcctagtactctccttaataatggtggtgtttagcaaattgtattacataaataaatatttatttcatggattgagttatgttgcatattaaattactttccttcccattgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttctggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctctgtgggctggttcagttctgcattcccattccagtgtccactgccttctcgctatccctcccatctgtgcgccaccaccagcttatccccagccctgctaacatgacaaactattgtgcatttgagtgcccactatacaatgtgtgaatataaccgtgcttttaagcattgactttaatgtctgggatgatccgtctagagtccatggaaccctcctgtgttttttcatccctttcttagtaatcttggaaatccacttatgaaattctttttctaacatttctttgctgaacggcatttttaaaattactttcacggtgtttctttccagtttgatctctacacaaacacaactttattacttgcaccagaaatgatttcaaacactttaggaactgtggtaggcttaattatgacttcccaaaagatatccctataccaatccctggaacctggaaatgttctcttctatagcaaaagatatgattaagttaaagtcttgagatggagagattattctgggtaatctgggagtgccctaaatgcagctacatctatgcttatatagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagctatcaagtttgtgattatttgttactgctgccatagtaaattaatacaggagcatgcaggacagatctgtaatggcctgaactgaatttcaaggggtgtggaaaacagttactctttaacaccactccgtcttccccattagccatttggataagtcaaagatagccttagccatctcctatcttagttacttttctccttcaactgtattttgccattgtcgttgccattgcctctgcctaactgcaagccatcatcatctctcacatggactatgacgacctcctcatctccctgtatcttctctaatgcttctctcatatacatgctctcagcagccacctggtttaaaacaaaaacaaaaaaaacactaatcatgtcattccctgcttgtcttcccgttctttccaactgtcattccctgcttgtcttccaattctttccaactgcagttaagatcaaaccaccaagacctcaccaggctcccatctacttttcagcctcaactcagtccacctgctctgccaatcacacctgtttctttttgttgttctttccctaggatatagatcctggcatacctgcattctgattcttcttggaacaagccaaattctttcccctgtcagtacgtttgcatgtgtagtacatgttgcatcccaggcctgtctgccttcttaccctattttattttcatcatagcacttactaccatctgaaatgatctcatttatggtttgtctcctcagtgattaacacagttcctgcacacagtaaatcagtagttctcaacaggaagtgaagaggtcatcctgaggggaacatttagcaatacctagagacatttctggttgtcataaccaggggaatgctcctagtggatagaagtcagggaggctgttaaacccattccacaatgcacaggactggaacaaagaatgatctctcactcagaatgtcagtgttgccaaggtggagacatcctgcagtagatgcttgtggcagagggtactggttgtaccccagtatccattctttcattcacctgtgttaatacatgctccagttttgtatttttttttataaacagctgtcaagcataaagataacattttccatctccttgtatgtaagtggaaataggactgtcatgtggggccagtttcttttttttcttcctctgtcctgctgcttgaaacatatgctgctatcttagatcatgaggtcgaggccatgcaaagtggagcaacaaggagctgtgtccctgacgccataagcaccacacctgtcctgaattgctgtgaatgacaccagctaactacaatgcattgtctcaacatcctagacataataaaaagccataaatatgtttgtcctatgcagcacaaaacctttgtatctttgccttttatgttgggatcttaattaaaaattacatcctctactgtc

SEQ ID NO: 616 - DNA, 1059 bp, Homo sapiens
tgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagaaaagccacagtcagcctggagctgctgcattcttggtaaaggaagtagaaagcttttaagagtgattcctggctgagcgtggtggctcacacctttctttaatcccagcactttggaaggctgaggcgggcggatcatgggagatcaagaccatcctggctaacaaggtgaaaccctgtctctactaaaaatacaaaaaattagccgggcatggtggcaagtgcctgtaatcccagctactcgggaggctgaggcaggagaatcacttgaacctgggaggcagaggttgcagtgagccgagatcgcgcttttgcactccagcctgggtgacagagcgagactccatctcagaaaaaaaaaaagtgattccttcccaagaaaatagttgttataatagttgtcatacctgtttctgtggaaaagaccccatcccagattatgccagacaccatgccgagagtagggccttgtttgatagcacttcaggacttgatctaatttctgcttgtatccagtttttgaaatatttaatagatgtcatttgttgagagtatgctctggactaagcacttggctaagggcttcgtatatgttgttttgtttactctccatgacagctcaataattg

SEQ ID NO: 617 - DNA, 474 bp, Homo sapiens
gggcttctgcgacccggggacccgtggggcgtaggccgcggagggagagcgccgctgcctggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaac

SEQ ID NO: 618 - DNA, 1059 bp, Homo sapiens; identical to SEQ ID NO: 616

SEQ ID NO: 619 - DNA, 1157 bp, Homo sapiens
gcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagcattccagttttggtgaatttttaagcaaaagaagccacaaaaatggcagcattggaaaacagactggttctagaaaaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggt

SEQ ID NO: 620 - DNA, 998 bp, Homo sapiens
gagcgccgctgcctggtctggagaaccccgcggagctggcctggcccgacccggcccggcccggtccgcggcgcggtggtcgagggcccgcggcgccttctgggagcgggagggccgggaagccgggcgttggtggagggaggcgttgggcttctgtcgccgcgaagctggcggaaaaggcagtggccagcgagccgcctcgccagttcccacgactcccagggaggtggcgacacccgcttcccgggccacccttttccccttcctgaccggggtccgtgcttgccttcccaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcag

SEQ ID NO: 621 - DNA, 942 bp, Homo sapiens
gtcccgcgcgtcggcggccgcggagcagcgcagggagccaggcgggctgccggcggatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcatt

SEQ ID NO: 622 - DNA, 498 bp, Homo sapiens
gggaagccgggcgttggtggagggaggcgttgggcttctgtcgccgcgaagctggcggaaaaggcagtggccagcgagccgcctcgccagttcccacgactcccagggaggtggcgacacccgcttcccgggccacccttttccccttcctgaccggggtccgtgcttgccttcccaggtgggggaaggtggaacactgtccatcccctggacaaaaacgctgcgcctcggggccttgaacccggttttgtttgaaaggaagcaagagaaaataagtgtttttccatttaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctag

SEQ ID NO: 623 - DNA, 746 bp, Homo sapiens
agcgcagggagccaggcgggctgccggcgggtgggggaaggtggaacactgtccatcccctggacaaaaacgctgcgcctcggggccttgaacccggttttgtttgaaaggaagcaagagaaaataagtgtttttccatttaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatg

SEQ ID NO: 624 - DNA, 1589 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttctgttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 625 - DNA, 688 bp, Homo sapiens
aggagcggccgggatgggcctccgggacggtgtgccaggccggggccaagtcggaggcccctcgctctgggtgggcgctggggcccgcgagggctactgaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacagg

SEQ ID NO: 626 - DNA, 669 bp, Homo sapiens
ggtgggcgctggggcccgcgagggctactgtaaggacccctggcttctgaggatactgcgtctagaactttctccgtatggggccttgaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggagg

SEQ ID NO: 627 - DNA, 1499 bp, Homo sapiens
ggtgtgccaggccggggccaagtcggaggcccctcgctctgggtgggcgctggggcccgcgagggctactgtaaggacccctggcttctgaggatactgcgtctagaactttctccgtatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgt

SEQ ID NO: 628 - DNA, 684 bp, Homo sapiens
tcgcccggagcccgaggcgcctcttcctctcccgctcggagcgccggccctccgctccggggcggggtgggaagcggaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgac

SEQ ID NO: 629 - DNA, 570 bp, Homo sapiens
agtgcagggggtcagggtggagagtggcggccccagcctcgcagggtaactgaactggatgttcttggctgcccagcgcttacaagtcccgtaccttttgtgccctgccaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagc

SEQ ID NO: 630 - DNA, 1413 bp, Homo sapiens
gagagttctgttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtacgtgg

SEQ ID NO: 631 - DNA, 793 bp, Homo sapiens
gagagttctgttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgca

SEQ ID NO: 632 - DNA, 1810 bp, Homo sapiens
ctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtg

SEQ ID NO: 633 - DNA, 1339 bp, Homo sapiens
ctctagggggcgctgccccgagactgggtggggagggaaagaaggtggtgcgaaaacgcgtttgaacttgggtcctgccgctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacagccagttctctatcaaagggcatttatttggactgcttccacatttttttttaagctaacttattccctgacagacttttcttcaactcagcatgacttcaactctccaactacacctgttaccttcagtgacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataa

SEQ ID NO: 634 - DNA, 1184 bp, Homo sapiens
cctgccgctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaataaaatgtatttgattttgtaagata

SEQ ID NO: 635 - DNA, 1143 bp, Homo sapiens
gtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacagccagttctctatcaaagggcatttatttggactgcttccacatttttttttaagctaacttattccctgacagacttttcttcaactcagcatgacttcaactctccaactacacctgttaccttcagtgacctggagcagttggctaaagagcaagacaaagaatcagagaaacaacttctactccaggaagtggagaatcacaaaaagcagatgctcaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaa

SEQ ID NO: 636 - DNA, 721 bp, Homo sapiens
atggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagt

SEQ ID NO: 637 - DNA, 2992 bp, Homo sapiens
agatttgggcgggctaggagggtttgggtcttcaggtcacatctggacggagagacctccggggcctccgttggtcggtccttccgctccggataccgttccggatgtcaggtagttcaggtcccgccccgacgccggccgtgacgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaa

SEQ ID NO: 638 - DNA, 1532 bp, Homo sapiens
aacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacat

SEQ ID NO: 639 - DNA, 1381 bp, Homo sapiens
tcctaaactgggatcttgggtaggaggaagaaaagataaggagttcctctatctgaaattagtcgggctgttttgaggagtactggttagataccttccgatactcctccaaagaactctcggattcaagtaaacaaacatccattaatacaagttaagtatgttccaggcgctgtgtgttccaggtactgttaacaaaagcgggttactagttaagacttccttcatgccctggcgcctctgctcagccagttcccttcgcctaggaggacctctctacaccaccccgctatattccctccccggaattccttcccaaccttcaaggaccatctgccccaactagtggcgaacatcgaggctgtcgtgactgtgtagatacttatttgacctgctcccttggcaaacacttgaaacgcaatacatgtttgtggaactgaacatagcctgtgcatgcagcaaggcttctttccctggaatcgcctgcccttcctccaacacagcgaccagccggtcagaatcccaacccctcgactccggaaatgatctgagagacggaacttccgaacgtcgcaatcagatttgggcgggctaggagggtttgggtcttcaggtcacatctggacggagagacctccggggcctccgttggtcggtccttccgctccggataccgttccggatgtcaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctgggtatgagctgttatatattaaaaatattttcttgaaaaaaaa

SEQ ID NO: 640 - DNA, 1342 bp, Homo sapiens
atggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaaggctggagtgcagtggcaccatctcggcccaccacaacctccatctcccaggttcaaatgattctcctgtctcagcctcctgagtagccaggattacagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccaggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaatag

SEQ ID NO: 641 - DNA, 2112 bp, Homo sapiens
ggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctgggtatgagctgttatatattaaaaatattttcttgaaaaaaaattaggtttgttgtttttcttaagagatgggttcttgctgtgttacccgggctggagtgcagtgtctaattgctggcactatcatggcaggcttcggtctcaaactcctgggctcaagtgatcctgcctcaggtcctgaatagccaagagcacaggctgggactataggtgcccaccactgtgccgtgctctatcccgtactttttgatatgtaattattattattattcagttggttcagttgtttataaattttccttatatgttctttgacccttgaattacttagaaatgtattttttaatttctaaatacttacaggtttaaaaattttgttttcaattactaatttaattctgtttcatcagaaagcacgaccatcgtggcattgaaacttgagttatagcctactatcatgatcaatttaaaaaatatatatatagggctgggtgcagtggtgcacatctgtaatcccagtgctttgggaggctgaggtgggtgaatcacctgaggtcaggagttcaagaccagcctggtcaacatgacaaaaccccatctgtacaaaaaaatacaaaaaattaactgggcttggtggcatgtgcctgtaatcccagctactcaggaggccaaggcaggagaatcacttgaacccgggaggcagaggttgcagtgagccaagatggcaccactgcattccagcctgggcaacagagcaacaacaacaacaacaacaaaatatatatatacacacacacacacacatatgtatatgtatatacacacatgtatatttttatgtatgtttcagaacatgtattctctaatggttggtgcagaagtctgtacgtgtccatttacatttaatcagtcttaataatacgtattttaaatctttcagtcatttccaattattttgtctaattatttactaagagagacatgttctatttgctactatggtggtagattttccattttccctttagttctgtcaattgtaggtgactaaaagttgtaattattgacccctggacatttatgcggactctctttctttctttgggcctagaaatggtttttaagtttatttgttgtaatttgcccaacagtcagtgattctgtagagagagtacttttcataaagtatactactcattattgttttttagccactatgcatctgagggtttgagttaatttttaaaatatgtaaatttaattactatggatactaatatcgaacatcctaggtttacgtgcttggtaaatgcttactgaataaaatcctgaacatttgtcttaggaa

SEQ ID NO: 642 - DNA, 1469 bp, Homo sapiens
accctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggg

SEQ ID NO: 643 - DNA, 2662 bp, Homo sapiens
acgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaaggccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactg

SEQ ID NO: 644 - DNA, 4458 bp, Homo sapiens
gccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccaggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaa

SEQ ID NO: 645 - DNA, 2047 bp, Homo sapiens
tcactattaacattttggtgcacttattctgtttttttcttacagctaaagtttattaagatgaatttttaaaaatataacatttaattgagtccaacacctccattaagcattcctctatgacaatacttttctcattatactgtcattacttgcttatacttctttaatactcctagactagattgtaaaggttgtgaggatgggaaaggtatgttattcatacagttacctaattttggcacaggaacccaaaactgagattcaagttctggtacactgactttgcaaggcccaagaatccaggtgtttatcttttcatttctatcaccagcacctggcccagaatctggcaggtggtgtaaactcagtgaatattggttgcttgaataaaggaatgaatgaacagatggatggatggttggatggatggatggatggatggatggatggatggatggatggatgtgggtttttatttattcttctttacccaaaattcattaactccctgtcaagtgccaggtctggctaggcaacagaaatataactagccatatttgatacgaggcatccctgtgaaggtactgacctcctctgatgtgggatagggttcctatgagtacagagcccaatcagccccctttggctggtcctcacggcttgtcttggaggggacccaagcccctccaggctctctttggcaagagacagagcaaagaccgctattccatggagtactattcctgtactcttcaaagtgctccagaaatccctagccttgggcctgtgttacccagagcgctcctcaactccctccgcgattccaagttgtccctgctcagtggtgggcgtgctgtggagagggtatctcaatggagaaagactatagaggagaggggcgccactgctccctcagatgagagcagcccttgacaaaccttccacctccccagccagctggcacaactggaaatctcagataagccccagttctggtcagaactggtttggcagctctaggggaaattttctgtctgactgaccctttccacagagggagctggcagttttgcagaacaaaacaaacaaacaaacaaacaaaaagaaagaaagcaaagaaaaggcggggccaaactaagggctgggaaaggcgcggggagggtgcggggctgggggcgcgggtagggtggctacatttaaaacactccaaacttctgctggcttccaagtttacactttgagattcaatcaagattgcccccacccctatcccgcattcactcactcatacacttctctacttggcaatgcagttttgttgcaatgcaatttggcagcgcgattgttgaagcaatataatcctgcacgcagcgcaccttttaatcaatgcatttttttcctgcaatgctcttgttattatttttattgcaactgaatctctgaacccttttccctccccattcgaatcgcgctccggctgtgattgctcgggtctgactttgcaaaggtcccgccattgatctggaaaaagtaaagtcagaatgtctcgagcccgagccggagttacggagcactttcagtgaggaagcaaatacgtcgtcctattaccccgctcctgcgcctgtcatggacaagtatatcctagacaatggcaaggtccatctgggaagcgggatttgggttgatgaggagaaatggcaccagctacaagtaacccaaggagattccaagtacacgaagaacttggcagttatgatttggggaacagatgttctgaaaaacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcat

SEQ ID NO: 646 - DNA, 1716 bp, Homo sapiens
gagactcgcgccccccgccggatccccacctccgcgcccgccccgcgggctgagctgcccgaccggggcccgcccccggcgcccaccatgtacgcctttgtgcggttcctggaggacaacgtctgctacgcgctgcccgtgtcgtgcgtgcgcgacttcagcccccgctcgcggctggattttgacaaccagaaggtgtacgccgtgtaccggggcccggaggaattgggcgccgggcccgagagccccccgcgcgccccccgcgactggggcgcgctgttgctccacaaggcccagatcctggcgctggcagaagacaaatctgaccttgaaaacagtgtgatgcagaagaaaataaaaatccccaagctttctcttaatcatgtagaagaagatggagaggttaaagattatggggaagaagatttacagcttagacacatcaagagacctgaggggcggaagccgagcgaagtggcgcacaagagcatcgaggcagtggtggctcggctagagaagcagaacggcctgagcctgggccatagcacgtgtccggaagaggtcttcgtggaggcctcgccaggcacagaggacatggacagtctagaagatgctgtggtgccccgggctctgtatgaggagctgctgcgcaactaccagcagcaacaggaagagatgcgccacctccagcaggagctggagcggactcggaggcagctggtacaacaggccaagaagctcaaggagtacggggcacttgtgtctgaaatgaaggagctccgtgaccttaaccggaggctccaggacgtgctgctcctgcggcttggcagcggtcccgccattgatctggaaaaagtaaagtcagaatgtctcgagcccgagccggagttacggagcactttcagtgaggaagcaaatacgtcgtcctattaccccgctcctgcgcctgtcatggacaagtatatcctagacaatggcaaggtccatctgggaagcgggatttgggttgatgaggagaaatggcaccagctacaagtaacccaaggagattccaagtacacgaagaacttggcagttatgatttggggaacagatgttctgaaaaacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcataaagctttcgtgttttccttgtgtggcatgtgatttgcgagcgatggtgccgtccaaatcagaccccaccgtgcatggtggtgtgtgtgcagggatccatcgggttctggggtcagcggcttgttctgaatgtggacactccaaagacgacagatggctttgctgagactcaggagcagcctggcactggtgtccttctgggaatggggaaaacactcttcttggagggggataaggttgcctgagttgcctgtcacttgactggggtttgaatggatatttttactatccaaggacttctttgttgctctattttgttctataataaattttcattaattctttga

SEQ ID NO: 647 - DNA, 6565 bp, Homo sapiens
tgagaagacaagagcaagggactgagagcaggcttccgctgcggcgcgcgaacacagccgggacacaacccccagcgtctccacccgctcctcgccaccccggcgggaatgtgaggaaggaaagcccccagcgccgccgcccgccctcgaaggcgtcccagagagcgtcctgggggcccgcggctggagcccttgtgcccgcagcaccgccggactggagcggcgaggcgcaccgggtgccgcttctcggcttccactcttcagaaagagcgcggtggggatcagcgcctttcccgcactcggcacaactccgggaccggcggcgcgcggctggaccgagtcccgcttcccgccagctcacctggagtcgggggcagcccctgcccgcccgcctgcaccccttgtcgctctagcttgcgcgaacctgccgctcctccacgcccaggtagtgagccccgcggctccaggtctctgcagcgccctcggccccatggacagcgcacccatcaccactccctaagtgctggcgccgccgctgtccaagctgcgcactggggtccctcggctcgcccctctctggggtgtccgagaggccagggagcgtgcaccatgaagtccgcgcttttcacccgcttctttatcctcctgccctggatcctaattgtcatcatcatgctcgacgtggacacgcgcaggccagtgcccccgctcaccccgcgcccctacttctctccctacgcggtgggccgcgggggcgcccgactcccgctccgcaggggcggcccggctcacgggacccaaaagcgcaaccagtctcggccgcagccacagccggagccgcagctgcccaccatctatgccatcacgcccacctacagccgcccggtgcagaaagcggagctgacccgcctggccaacacgttccgccaggtggcgcagctgcactggatcctggtggaggacgcggcggcgcgcagcgagctggtgagccgcttcctggcgcgggccgggctgcccagcactcacctgcacgtgcccacgccgcggcgctacaagcggcccgggctgccgcgcgccactgagcagcgcaacgcgggcctcgcctggctgcgccagaggcaccagcaccagcgcgcgcagcccggcgtgctcttcttcgctgacgacgacaacacctatagtctggagctcttccaggagatgcgaaccacccgcaaggtctccgtctggcctgtgggcctggttggtgggcggcgctacgaacgtccgctggtggaaaacggcaaagttgttggctggtacaccggctggagagcagacaggccttttgccatcgacatggcaggatttgctgtaagtcttcaagtcattttgtccaatccaaaagctgtatttaagcgtcgtggatcccagccagggatgcaagaatctgactttctcaaacagataacaacagtcgaagaactggaaccgaaagcaaataactgcactaaggttctcgtgtggcacactcggacagagaaggttaatctagccaacgagccaaagtaccacctggacacagtgaaaattgaggtataaattgaagcagcaactggtgcagtttgtccagccagtggatccatatggaagaggatgtttggagtttaggctacagagcattcaggtattgtttgttttacttcagtacagcagcctttcttgtcatctgatggacatctgtttaaatggagcttgtcagttaacataagctaattggatggttggtacaaaatgtatgttttgtcttcatttgttctgcatgttttctctacaacaactaaattggaagatttttttgtacagtgccgatactgcaagataccactcttgagtatatattttttctttttctccaatttgcccttataattggtagacttgaacaggttggtagacttgaacaggtttttaaaacagacaagtattttgtcagctaaacgttcctgatgattcctgactttgcaatactaagtaatttttggaaggttagtggcagtatacatcataggaaataaaaacccacaaatgaaaaggtctatggagtcatgtttaatgtagggaaataacattttgtcaatactaggcaccataaaatgtaaacacaattactgtcataaacctagatataccttcaaggattgaagattgaaagtggctttgttttagttagttaccctgtttgcatatagtgcagaaaaaggtcttcatgttagcactatgtacattaagaagagatccaaattacaagagaggcagataaaatttgaattctttaagcattcattaaacgaagttttggagtaacatccacgtttatcttcctttcactaatcacgttccctgttaagcacatcataacaacagcacagtgaagtgaatgatgaaataagagcattttgatacactagaaaacagtgctcagtgagacatttacattctatttatatgattaaacatttgatcatacagtaccttcctacaggattactggctaattttggggtggggtttatactattagaggtattactaacatgataactacttcccttatatgcaaacattagagctataattttattgagaggaaaactgattttgcaagttgagcagcttctcaaataatgcagtacatgaaatcatgggaaatatgagcaaagctgcccttgacataaaatgatttatcaacctgcttttcaccacatcaaattgaatcagtacagaccaacacggtcaatcagatcattcttaatatgaacaaatgggtaaaaagaaaaaaaatatgcatatgaataaacaggggaactagatgcgtttcagcaaggaatgtcaggtggtagttctggatgaaacttgtattgcagttttcatttccacagttgtgtgctgagagtctgacctgatgagcttccagaccatcctgctgttgtgctggagggctggccaaaacctgcagtaggggttgcactactgatactcatgccagccatctgctgattcatctgtgaaacatataaaaggcttagttcaagaggcttacttcacttttaattcttgtttctttagccacacagttggtcattttttcattaatgtgacaactagtccaagcactggaataaaaacagagtaccatacaaatatttcttaaagcaaatagctactttgttcccttctttatctactttctagatacagtttccccaaagattaaccacaacttacttaaaaaaaaataccaaagcaatcttgggattttaatgagtccgctactctaactaactttcacctacactaggatattgtgctttaactactaaggagtaagaaaattttaggaagtaaaatagtctaaaattatcctataaactttgtatgatagatattattctctattaaaatcttatatacttcctaaatatttttaaagtggtcataaagcatttatttctctcgctgatctaacaacataaacatctaaaatttattttcattgtatgcaataaagcataagattacatgtatttttcttcaagactggagtcaaatatatatatatataagcatcttaaccctgtgattctcttacttccaaaattggtgataagagaaggaaaggcaagatttaccatatagtgagtgggtttaaaacttacactcagagttagactgtgttcttaatttaatacatttgacttgacttatttacagtttcaaagacactaacataaactacatcactaatcaggcataagtgtctgaagaagcagatcacgtcttcatacctactaaaggacattttaaccaccttgtcattggccagtagattgcactgatggagtgctggagaacagcatcacccttctgcattatctggaagtaagagccagtattaactccttcctggttcatctagcaccttaacctgagctgggtgtgcttcagcatgttgaccatgtgactgacacttagcacatacaattttttagattcccagcgggtagagaccaatgttttacctatattcttgtaaatggtggtagcaaaattaactgtgatatatagtgattgtgctaatgttagaaatcactctagactattccctgaatgctctaaaggtaaaacaagtgaccaaacagaaaccaagattgccaaaatgctggaggaacatcaatgggaagtgtaaaaggaagaagagtgggagcatgaacctctctaagagcctttgtctgtgcagctagagaaaagtcagaacacagcacctgaaatagaaatgttctatctcagctctaacttaggtagaaataggattttataatatgaggggatgtctggttcacaccttatgggaattgaatctttttgtactctttttaaacataaaagtcattatagggtatgtaaaaagaaaatacaactttacaaaggtttctcaacaaaaagaatttttacagagccatggggcagtaatcatccgacctgaaaaatagccttagatccctcataaaatagtgctttgagaatatgaggctagatttttattttctaataaaagatcctaaaattattagtgaagctaagttgtctaagtggactgtaaaaatgtcccaccagcaagctggataaagcttagtgctaatctcagaggtgacagagagggagtctcatgatgcctgagataatttctggccattagtggtgttcacgttacagttacattacaatttgaaatgaaagatgtttaaccttttttttacagaatactctaaaatagcgataataacacatcatttgtctatctgatacaacttcataatatttatagatacttttgaccctataacatattatccctattgaattctttctgccagatcactagacttaaaaaaaaaaaaaaaaaaaaaaaaaaaagatttagaaaataaatctggtttgatttgggagaagctagaaagtaaatgacccctacctgtgagaggctccactggggctgctgagcttgcggcaggccaaacttactctggggtgcacccatttgtcccaccattcctccttgggggccaacaacgttctgaggaagtggcatcacaccagtttgtgcatttcccataaacccattgggcatgggcatgcccaccatcatgcttggactctgtcccatcacatttcctataaggccaggagctgcaggcacaggcacgcccatcgatggaaagccctgaaatgcagctggtgcttgtgaggtaaatggtatatttgtgggtcccataaatacacctgcaccacaaaaagaaaatgaatgaagacagagctatcacgtgtagttgcactcatctctataatcacagaaaaattgcctttctgaactactcacagcaaacattttaattccagtttggctgctcctactactcagaccaacccacacctaaaccctgagagctggttgtttctaggatgcagacaaatcagttattaacctgagtaaatttaattaagaaatgtaaatcatatgcaacagccacacaaaatatcttccactgtgaagaccaaactatgtagcatgacatcatacactgttttattgctgatttgtaccactggtcccccagtacgaaacagggaagtgagagctgactatatctcgcttcaataggtgtagtgggctgcccaacaattttagctcacatgtgaaatgcagctcattattttaaaggaaatggtgtgaaagattaaaactctgtaaacaataaggcttatgctaatattttgttatgattacaaaaaaattcatagattttttttaatccatgtggtaactcaagactgtttacctgcagagaaaatacactgtacgcagtcataaacttcatgcaaatcgtttcaataattcatcaaagataatccatgttctataagcttgtgaaacaacatttagtgatctatgaacagcttgttaattccaaataaagttctgtgaatcctgtacatgcctcttaattttttaattctaatgctcattcatttcggcttcatagttgtataaactgcaacaacaaaagcactcactacatggaacaataaaagatatataattgatcttattatataattacaaaggatgtacttctagtaatgtcactgaaagcagatatcaaaattcattaccaggagtactttgctgttgaatggttcctgtgccatacagagataagatggagtctttggaaagttgtttctttgccacttcttctgattttgtagtttgctcagtgaataaatctagatccccagatgttactgtagacagggttgcagctgctggtgcagagggtgtcccctgagacaaacaccaaaataagctatcaaattctgcatagtaaagcgcagcttatccattacttaaaatccaaataaagttataaaattagataggaatcaaacaattgtagaaggtaaaatggtgccattcaagaggatcacttacaagcccaagcccatataaaaacatctacaatca

SEQ ID NO: 648 - DNA, 3270 bp, Homo sapiens
gtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataa

SEQ ID NO: 649 - DNA, 3221 bp, Homo sapiens
ttccggccgcggccctggcgcgtggtctgcgcgcgcccggccgtgcgtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataa

SEQ ID NO: 650 - DNA, 3437 bp, Homo sapiens
gcttccggccgcggccctggcgcgtggtctgcgcgcgcccggccgtgcgtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagtcttgctgctctgttgcccaggctggagtacagtggcaggatctcagctcactgcaatctccgtctctcaggtttaagcagttctcctgcctcagcctcccaagtaggtgggactacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataa

SEQ ID NO: 651 - DNA, 3606 bp, Homo sapiens
gcgtggtctgcgcgcgcccggccgtgcgtgcggatgcggggaggctgcgtgtgtgcgcagggagagaacgccggccaccttcccgcttccgagctgggtgcgcgccgagcacaggagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagagacaaggccactttatgtttcccaggctggactggaacccctgggctcaaatgatcctcctacctaagcctgcagagtagcgaggacttcagttttcttagctccctggacccggttgacctgttggctcttcccgctggctgctctatcacgtggtgctctccgactactcaccccgagtgtaaagtcttgctgctctgttgcccaggctggagtacagtggcaggatctcagctcactgcaatctccgtctctcaggtttaagcagttctcctgcctcagcctcccaagtaggtgggactacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgta

SEQ ID NO: 652 - DNA, 1107 bp, Homo sapiens
ctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgaaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaa

SEQ ID NO: 653 - DNA, 914 bp, Homo sapiens
gtgtgtgcgcagggagagaacgccggccaccttcccgcttccgagctgggtgcgcgccgagcacaggagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagagacaaggccactttatgtttcccaggctggactggaacccctgggctcaaatgatcctcctacctaagcctgcagagtagcgaggacttcagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgag

SEQ ID NO: 654 - DNA, 572 bp, Homo sapiens
tgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagtcttgctgctctgttgcccaggctggagtacagtggcaggatctcagctcactgcaatctccgtctctcaggtttaagcagttctcctgcctcagcctcccaagtaggtgggactacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgattta

SEQ ID NO: 655 - DNA, 2123 bp, Homo sapiens
cacttttccaagcagtaaggaatgatgccatcctcaagtacggattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaa

SEQ ID NO: 656 - DNA, 552 bp, Homo sapiens
gagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagagacaaggccactttatgtttcccaggctggactggaacccctgggctcaaatgatcctcctacctaagcctgcagagtagcgaggacttcagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactaca

SEQ ID NO: 657 - DNA, 1660 bp, Homo sapiens
gcgccgtcctcggaaacgcctagaccccggcagctaggccgggaggcaccgcccactcctctagagcggagcgtggcccaggttgagccgccgcaccgtgggtctcgggtctcggtgacgagcagctgcccgcctccggtgagcgcgggagaaggggcccagtggggcagtgggcgacgcggagggcccaggcccaggccgcggccgcgccgcatccgctggttgtccaccttgccttgccccagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaa

SEQ ID NO: 658 - DNA, 662 bp, Homo sapiens
agagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagtcttgctgctctgttgcccaggctggagtacagtggcaggatctcagctcactgcaatctccgtctctcaggtttaagcagttctcctgcctcagcctcccaaaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttca

SEQ ID NO: 659 - DNA, 666 bp, Homo sapiens
gtgcagccaggggcttccggccgcggccctggcgcgtggtctgcgcgcgcccggccgtgcgtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagtcttgctgctctgttgcccaggctggagtacagtggcaggatctcagctcactgcaatctccgtctctcaggtttaagcagttctcctgcctcagcctcccaagtaggtgggactacagaaccttcggctcgcgtgcttctgagctgctgtggatggcctcggctctctggactgtccttccgagtaggatgtcactgagatccctcaaatggagcctcctgctgctgtcactcctgagttt

SEQ ID NO: 660 - DNA, 541 bp, Homo sapiens
ggcccaggccgcggccgcgccgcatccgctggttgtccaccttgccttgccccagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgag

SEQ ID NO: 661 - DNA, 1874 bp, Homo sapiens
ggaggagcggggccgggagctgcgaggagccctccagacgtcgccgagcgcgagggcgggcgtgctcggagtggtcgctcgtcagccgccgcccctcagtctccgcacttgcaggtcccctccctctccgccgggacgcgggagagcccggctcgcggcgggggcggccaatgcgaaactggctggtgctgctgtgcccgtgtgtgctcggggccgcgctgcacctctggctgcggctgcgctccccgccgcccgcctgcgcctccggggccggccctgcaggtggagtctcactcttgttgcccaggctggagtgcaatggcgcggtctcggctcaccccaacctccacctcccgggttcaagagattctcctgcctcagcctcccaagtagctgggataacagatcagttggccttatttcctcagtggaaatctactcactatgatgtggtagttggcgtgttgtcagctcgcaataaccatgaacttcgaaacgtgataagaagcacctggatgagacatttgctacagcatcccacattaagtcaacgtgtgcttgtgaagttcataataggtgctcatggctgtgaagtgcctgtggaagacagggaagatccttattcctgtaaactactcaacatcacaaatccagttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggaggccctcttcattgctcgcttcagtcctccaagctgtggtgtgcaggtgaacaagctgtggtacaagcccgtggaacaattcatcttaccagagagctttgaaggtacaatcgtgtgggagagccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcagggtaagtttgctagttgaaacttgaaaagtacactgaatgtcttacacttaatctttatacttgagagaaaaggattttttcttttttgtcttttaaaaaactttattcagataaaattcacccttttaaagtggttcagtggttttagtgtattcttagagttctacaaccggctccacctcccaaaaggaaaccccacacccattagcagttactcctcattcttacctccccaaccccccaccccctaacaactactgatgcactttctttctctatggatttgcctgttttgaacatttcacataaatggaaatgcacagtacgtactctgtgtgtcagtttctttgctgtaacatgtgttccaggtctgtccattttgtatgtatcagtacttcttttttatgatcatataatattctattgcatcgatatgccctattttattcattcattaatggatggacatttagattgcttctactttttgaatatgaataattctgtagtaaacatgtaggtacaagtttttgtgtggtcatatatttccatttctcttaaatgtctaggagtagaagacctgggtcatataattgtgtgtttaatcacttgaggcactgccaggttgttttctaaagcagcagcccactttacatttccatagtcagtatatgaggattctagtttctccatattcttgtcaacacttaataaattgtctgtcttttaaaatataccaa

SEQ ID NO: 662 - DNA, 4843 bp, Homo sapiens
aggcggagggggcggggcttcggccggctaagccgcggccacccgcggtctgagggaccggaggagcggggccgggagctgcgaggagccctccagacgtcgccgagcgcgagggcgggcgtgctcggagtggtcgctcgtcagccgccgcccctcagtctccgcacttgcaggtcccctccctctccgccgggacgcgggagagcccggctcgcggcgggggcggccaatgcgaaactggctggtgctgctgtgcccgtgtgtgctcggggccgcgctgcacctctggctgcggctgcgctccccgccgcccgcctgcgcctccggggccggccctgcaggtggagtctcactcttgttgcccaggctggagtgcaatggcgcggtctcggctcaccccaacctccacctcccgggttcaagagattctcctgcctcagcctcccaagtagctgggataacagatcagttggccttatttcctcagtggaaatctactcactatgatgtggtagttggcgtgttgtcagctcgcaataaccatgaacttcgaaacgtgataagaagcacctggatgagacatttgctacagcatcccacattaagtcaacgtgtgcttgtgaagttcataataggtgctcatggctgtgaagtgcctgtggaagacagggaagatccttattcctgtaaactactcaacatcacaaatccagttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggaggccctcttcattgctcgcttcagtcctccaagctgtggtgtgcaggtgaacaagctgtggtacaagcccgtggaacaattcatcttaccagagagctttgaaggtacaatcgtgtgggagagccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcaggaaggtgatgctctcttacacaaccttcattctcgccctcaaagacttattgatcatataaggaatctccatgaggaagatgccttactgaaggaggaaagcagcatctatgatgatattgtttttgtggatgttgtcgacacttatcgtaatgttcctgcaaaattattgaacttctatagatggactgtggaaacaacgagcttcaatttgttgctgaagacagatgatgactgttacatagacctcgaagctgtatttaataggattgtccaaaagaatctggatgggcctaatttttggtggggaaatttcagactgaattgggcagttgaccgaaccggaaagtggcaggagttggagtacccgagccccgcttaccctgcctttgcatgtgggtcaggatatgtgatctccaaggacatcgtcaagtggctggcaagcaactcggggaggttaaagacctatcagggtgaagatgtaagcatgggcatctggatggctgccataggacctaaaagataccaggacagtctgtggctgtgtgagaagacctgtgagacaggaatgctgtcttctcctcagtattctccgtgggaactgacggaactgtggaaactgaaggaacggtgcggtgatccttgtcgatgtcaagcaagataacagggacttgaattagcagagtctaaaatcagggcaggcaaacgataatctgagtgcaagtctgaggagtcccagggtttagcagtagactgtatggtctttcaagagagttccagactggcactttcacccagaaccaatgcggtgtttcttaatgtttgcacaaatttccttaaaaatcaacttgtactgtagcataagaaaagtttttatttatctattggaagattatcagaaaaataccaagttattttataaaagaaaaaatatttctaaatcctgatgcattgtggctaattagtaattcaccattacctatagtttttggttaaaacttggcctagttcagaaatctgtagtagtaactgagagtttgaatttcaacctggattgcaggatagctctgtagagctaattaggataattatcagacaaaaaggaactcacaggaatgctgtgtgatcatgtgatcacatatttgagcagtggtcacttataccaaagtttggggtttctggaaataatgtcagattttgtggatctctgaagtgggcaacttgaactaacttgaagaggaaccaatatgattctcagttctgaaccttggttttaaagaagttcatttatatggtagactaatacccaaattttctttctgccatctaacataaatcctgaaggtcacagtttagtactcatagtttttaaatgctaaagttgtgtgagtatgaataaaagcaaatacctctcagggttttagtgccatcgggaaggatatttctaaattttgttgacattttgaaagaattagttttgctttcctcctatcattgcctaatgtttacctaatatgagtacatttcaatcaaagctggttatcacagaagaagatatactcagcttaggtataattgtagggaaaagcatgtgattaatttaagtactcttagaaatagtgcaactgagaagacagataatagcatattgttatacatagtagaggatgtctccccaagtttaagggacatttcccaaaatgaccaaccaaatcatttctagtaaccctttaaaatagtagtttcaatagagaattccattaaaactagtcttatgacagatattaactgtgttcagattttattaggctagctagtttctttctatttaatatttaaatcttatcatgaaatgcagtgatgagctgtaaaaataaatatgaaataagatcagaaaatcattagtaggttcaaagcctttattattgctattatgtataagcctagaaatggtcacttcccaacaaaaaatacatcccttgttatacttaggacaagttgtaaaccccctttgttttgacagtagaattgttccagtgaatcatttatttccggtgaaccccagacacgataagcagtgtggtctttaaattttattagttggttgtcaccatcgcactaatagacaatctccattttccacagaataaaactgtaatgactttaggtcattttccagctcgatttctctgcccggcttctaaaattagaacgaaggtggggaaggatgtgattaagacagatccgataaagcatgctacacatactcttcccccaccccgtccccaggcagtagcttacccttaaaatcaaacaaacagacccatggtctccatttagaatcaaactgttgctatctagagacagtttaatgtcataatacgaggactaagcttgactttgactttgtattttgctgggcaacttactttgggactttcataggacaacagaaggtctgacacaggaactttgagaagacgtgacagcaatcccttcaccttttgaattgtcatggagcctatcaaaagacaagaaaagtccattcgttctctcaaatgacagttacctgtaaaactagctcatgtgatgagaccacagtatcattgcaatgatagctgtatctgtcttttttttttttttttttttgagactgacttacttacttacttaagtaagtcttgctctgtcgcccaggctggagtgcaatggtgtaatctcggctcactgcaacctccgcttcccgggttcaaacaattctcctgcctcagcctcctgagtagctggtgcccatcaccacacccagctaacttttgtatttttagtagagacggggtttcaccatgttggccaggctggtcttgaactcctgacctcgtgatccgcccgccctggccccccaaagtgctgggattacaagcatgagcccagcgcctggctgtatctttcattttacccaagtcactttacccaagtaagtaattaggggaaagcctgagtcttgtaccacctgttcatttggggaactgtgggaaacggagccaacggacctaagtgccctttgacagtgagtttcataccatttcagtagtgtatttctttcttaatctgaataaaccagaatgatactctcagcacagaagaataaagggagcgagtcattaacgttttctttttaaacctttatgatgacttccttatgaattactgaacgaacactggaatgggactcaggtatcctgaggacatctctcaactctggccttagttccccctctgtaaaattagggtgccaactaaatgatctacaaggtcccttccagcgccgccattctgtaattacatcatgtgtaactgtattaaacatacacaagtgactgccaggcatgggaatgtaacttccgagtaaatgctttggtttgttcagaatacactatgaacttctttccaaagacgggttgtggtaaatagtggatattttgattataagaaatagagtttccttgaagctttagctggagatacagcaatagtgtggtgttcctacaaatatcacagtgtattcaaacatatttttctatcaaaaatcatttttgtaaaagctgtgtgtttttatccaacttgtgataataaatgttctttattttagaat

SEQ ID NO: 663 - DNA, 2015 bp, Homo sapiens
aggcggagggggcggggcttcggccggctaagccgcggccacccgcggtctgagggaccggaggagcggggccgggagctgcgaggagccctccagacgtcgccgagcgcgagggcgggcgtgctcggagtggtcgctcgtcagccgccgcccctcagtctccgcacttgcaggtcccctccctctccgccgggacgcgggagagcccggctcgcggcgggggcggccaatgcgaaactggctggtgctgctgtgcccgtgtgtgctcggggccgcgctgcacctctggctgcggctgcgctccccgccgcccgcctgcgcctccggggccggccctgcagatcagttggccttatttcctcagtggaaatctactcactatgatgtggtagttggcgtgttgtcagctcgcaataaccatgaacttcgaaacgtgataagaagcacctggatgagacatttgctacagcatcccacattaagtcaacgtgtgcttgtgaagttcataataggtgctcatggctgtgaagtgcctgtggaagacagggaagatccttattcctgtaaactactcaacatcacaaatccagttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggaggccctcttcattgctcgcttcagtcctccaagctgtggtgtgcaggtgaacaagctgtggtacaagcccgtggaacaattcatcttaccagagagctttgaaggtacaatcgtgtgggagagccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcaggaaggtgatgctctcttacacaaccttcattctcgccctcaaagacttattgatcatataaggaatctccatgaggaagatgccttactgaaggaggaaagcagcatctatgatgatattgtttttgtggatgttgtcgacacttatcgtaatgttcctgcaaaattattgaacttctatagatggactgtggaaacaacgagcttcaatttgttgctgaagacagatgatgactgttacatagacctcgaagctgtatttaataggattgtccaaaagaatctggatgggcctaatttttggtggggaaatttcagactgaattgggcagttgaccgaaccggaaagtggcaggagttggagtacccgagccccgcttaccctgcctttgcatgtgggtcaggatatgtgatctccaaggacatcgtcaagtggctggcaagcaactcggggaggttaaagacctatcagggtgaagatgtaagcatgggcatctggatggctgccataggacctaaaagataccaggacagtctgtggctgtgtgagaagacctgtgagacaggaatgctgtcttctcctcagtattctccgtgggaactgacggaactgtggaaactgaaggaacggtgcggtgatccttgtcgatgtcaagcaagataacagggacttgaattagcagagtctaaaatcagggcaggcaaacgataatctgagtgcaagtctgaggagtcccagggtttagcagtagactgtatggtctttcaagagagttccagactggcactttcacccagaaccaatgcggtgtttcttaatgtttgcacaaatttccttaaaaatcaacttgtactgtagcataagaaaagtttttatttatctattggaagattatcagaaaaataccaagttattttataaaagaaaaaatatttctaaatcctga

SEQ ID NO: 664 - DNA, 3036 bp, Homo sapiens
acgagcaggcaatggaatggatgtcgtgggagcaggcggttgagatgccagtgtttggaggctaaggactgggggctgtgagcgaggaccttcccgcgtttgctccgcgcccccgcagtttcctccgcgcccactagaaggcgccggggcgctcgcattccccgcgcggagccgaagcagccgcaacgagccgggagctgagccgcgctgcgctgcggtgcgaagagccgggcggcggccagagccctccccgcgctgccagtgggacgcggagccagggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtgatggcccgctggggatttctgactgtcaggctgggcctgcctccttgtccctgccaggaatttccaacaaaccccaccaccctgtgagcactctactggctgtccctgagcctctagttcctcactcttccttttcagaacctgatgcccagtaggggttgtcctggtgacacccctcctttttccagtgcccagaggcctggtggagccataacctctcccacagccagtgccaagtcctccccctgcccattctcatggggcaggaaatggggggatcactttccaagtgccaaagagcccagagggactctaagaacctaaggtggaaacactgtcctctcatcttgggaccgagggggtggggaagttccccaacacataatcccaagactgtgcccctcatctgcatcttcagatccagtactctgtgtacctgctccagccccacccccacagagagaacttgtggctctggggctggggtgagggctggtggttggtgaaagccattcttagttgtgtctctgcaatgctgtgggcacaaaagaaggggcaccagagtccctgtgcaaacacctagactcacttcatggattccaaagctctcagcttcattttattagttacgttaggtaagggggttcaagggtcatggtcctcatcacacacatgtcatcagggccctctgcactccacatgatgaggtcagacccacacggtgcaaatctttgggtcagtgagctcctggagaagagaggagacatgtcaggaatagattaggcacccctcttccttaatgaaatgtggcagtcctctcaggggtaccccacctacttagggatctgag

SEQ ID NO: 665 - DNA, 841 bp, Homo sapiens
cgcgccgcttgccgaggccactcatcgggtcacctccgccgggggcgcccgccagcacgggcatgattctgcattttttcctgacaggctaggtgtggagccgccctccgcagcccaccccggcccaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacag

SEQ ID NO: 666 - DNA, 837 bp, Homo sapiens
gctcgcattccccgcgcggagccgaagcagccgcaacgagccgggagctgagccgcgctgcgctgcggtgcgaagagccgggcggcggccagagccctccccgcgctgccagtgggacgcggagccagggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggctaggtgtggagccgccctccgcagcccaccccggcccaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcagg

SEQ ID NO: 667 - DNA, 1906 bp, Homo sapiens
ataggtggctgcagaggcgaggtgacggcgcgtgcggaacgaactctgcacccccaggaatggggagcgctggcttttccgtgggaaaattccacgtggaagtggcctctcgcggccgggaatgtgtctcggggacgcccgagtgtgggaatcggctcgggagtgcgggcttcggggctctctgcttggaactcagaggcgctgacccagcctggggcccgtttgctgcccacgggaggagccgccgtcagggctcgagatttctgtggctcctcaagatattggtcataatcctggtacttggcattgttggatttatgttcggaagcatgttccttcaagcagtgttcagcagccccaagccagaactcccaagtcctgccccgggtgtccagaagctgaagcttctgcctgaggaacgtctcaggaacctcttttcctacgatggaatctggctgttcccgaaaaatcagtgcaaatgtgaagccaacaaagagcagggaggttacaactttcaggatgcctatggccagagcgacctcccagcggtgaaagcgaggagacaggctgaatttgaacactttcagaggagagaagggctgccccgcccactgcccctgctggtccagcccaacctcccctttgggtacccagtccacggagtggaggtgatgcccctgcacacggttcccatcccaggcctccagtttgaaggacccgatgcccccgtctatgaggtcaccctgacagcttctctggggacactgaacacccttgctgatgtcccagacagtgtggtgcagggcagaggccagaagcagctgatcatttctaccagtgaccggaagctgttgaagttcattcttcagcacgtgacatacaccagcacggggtaccagcaccagaaggtagacatagtgagtctggagtccaggtcctcagtggccaagtttccagtgaccatccgccatcctgtcatacccaagctatacgaccctggaccagagaggaagctcagaaacctggttaccattgctaccaagactttcctccgcccccacaagctcatgatcatgctccggagtattcgagagtattacccagacttgaccgtaatagtggctgatgacagccagaagcccctggaaattaaagacaatcacgtggagtattacactatgccctttgggaagggttggtttgctggtaggaacctggccatatctcaggtcaccaccaaatacgttctctgggtggacgatgattttctcttcaacgaggagaccaagattgaggtgctggtggatgtcctggagaaaacagaactggacgtggtaggcggcagtgtgctgggaaatgtgttccagtttaagttgttgctggaacagagtgagaatggggcctgccttcacaagaggatgggatttttccaacccctggatggcttccccagctgcgtggtgaccagtggcgtggtcaacttcttcctggcccacacggagcgactccaaagagttggctttgatccccgcctgcaacgagtggctcactcagaattcttcattgatgggctagggaccctactcgtggggtcatgcccagaagtgattataggtcaccagtctcggtctccagtggtggactcagaactggctgccctagagaagacctacaatacataccggtccaacaccctcacccgggtccagttcaagctggccctccactacttcaagaaccatctccaatgtgccgcataaaggtgtgagggcataggagaaacactaggctggctggttatggtatctatagcaggccaccaaaaactggactcctgataggtgaacgttgtaccaaaccagctggtgggtagggaaaagggaaatggctcagttactggaagtac

SEQ ID NO: 668 - DNA, 1691 bp, Homo sapiens
agtctgagggcggcgggattcgggatgacttcgggcggctcgagatttctgtggctcctcaagatattggtcataatcctggtacttggcattgttggatttatgttcggaagcatgttccttcaagcagtgttcagcagccccaagccagaactcccaagtcctgccccgggtgtccagaagctgaagcttctgcctgaggaacgtctcaggaacctcttttcctacgatggaatctggctgttcccgaaaaatcagtgcaaatgtgaagccaacaaagagcagggaggttacaactttcaggatgcctatggccagagcgacctcccagcggtgaaagcgaggagacaggctgaatttgaacactttcagaggagagaagggctgccccgcccactgcccctgctggtccagcccaacctcccctttgggtacccagtccacggagtggaggtgatgcccctgcacacggttcccatcccaggcctccagtttgaaggacccgatgcccccgtctatgaggtcaccctgacagcttctctggggacactgaacacccttgctgatgtcccagacagtgtggtgcagggcagaggccagaagcagctgatcatttctaccagtgaccggaagctgttgaagttcattcttcagcacgtgacatacaccagcacggggtaccagcaccagaaggtagacatagtgagtctggagtccaggtcctcagtggccaagtttccagtgaccatccgccatcctgtcatacccaagctatacgaccctggaccagagaggaagctcagaaacctggttaccattgctaccaagactttcctccgcccccacaagctcatgatcatgctccggagtattcgagagtattacccagacttgaccgtaatagtggctgatgacagccagaagcccctggaaattaaagacaatcacgtggagtattacactatgccctttgggaagggttggtttgctggtaggaacctggccatatctcaggtcaccaccaaatacgttctctgggtggacgatgattttctcttcaacgaggagaccaagattgaggtgctggtggatgtcctggagaaaacagaactggacgtggtaggcggcagtgtgctgggaaatgtgttccagtttaagttgttgctggaacagagtgagaatggggcctgccttcacaagaggatgggatttttccaacccctggatggcttccccagctgcgtggtgaccagtggcgtggtcaacttcttcctggcccacacggagcgactccaaagagttggctttgatccccgcctgcaacgagtggctcactcagaattcttcattgatgggctagggaccctactcgtggggtcatgcccagaagtgattataggtcaccagtctcggtctccagtggtggactcagaactggctgccctagagaagacctacaatacataccggtccaacaccctcacccgggtccagttcaagctggccctccactacttcaagaaccatctccaatgtgccgcataaaggtgtgagggcataggagaaacactaggctggctggttatggtatctatagcaggccaccaaaaactggactcctgataggtgaacgttgtaccaaaccagctggtgggtagggaaaagggaaatggctcagttactggaagtac

SEQ ID NO: 669 - DNA, 1819 bp, Homo sapiens
aaggccgcgaggttggagggcacggggacacagcatagcgaggaaggaacgctcgagatttctgtggctcctcaagatattggtcataatcctggtacttggcattgttggatttatgttcggaagcatgttccttcaagcagtgttcagcagccccaagccagaactcccaagtcctgccccgggtgtccagaagctgaagcttctgcctgaggaacgtctcaggaacctcttttcctacgatggaatctggctgttcccgaaaaatcagtgcaaatgtgaagccaacaaagagcagggaggttacaactttcaggatgcctatggccagagcgacctcccagcggtgaaagcgaggagacaggctgaatttgaacactttcagaggagagaagggctgccccgcccactgcccctgctggtccagcccaacctcccctttgggtacccagtccacggagtggaggtgatgcccctgcacacggttcccatcccaggcctccagtttgaaggacccgatgcccccgtctatgaggtcaccctgacagcttctctggggacactgaacacccttgctgatgtcccagacagtgtggtgcagggcagaggccagaagcagctgatcatttctaccagtgaccggaagctgttgaagttcattcttcagcacgtgacatacaccagcacggggtaccagcaccagaaggtagacatagtgagtctggagtccaggtcctcagtggccaagtttccagtgaccatccgccatcctgtcatacccaagctatacgaccctggaccagagaggaagctcagaaacctggttaccattgctaccaagactttcctccgcccccacaagctcatgatcatgctccggagtattcgagagtattacccagacttgaccgtaatagtggctgatgacagccagaagcccctggaaattaaagacaatcacgtggagtattacactatgccctttgggaagggttggtttgctggtaggaacctggccatatctcaggtcaccaccaaatacgttctctgggtggacgatgattttctcttcaacgaggagaccaagattgaggtgctggtggatgtcctggagaaaacagaactggacgtggtaggcggcagtgtgctgggaaatgtgttccagtttaagttgttgctggaacagagtgagaatggggcctgccttcacaagaggatgggatttttccaacccctggatggcttccccagctgcgtggtgaccagtggcgtggtcaacttcttcctggcccacacggagcgactccaaagagttggctttgatccccgcctgcaacgagtggctcactcagaattcttcattgatgggctagggaccctactcgtggggtcatgcccagaagtgattataggtcaccagtctcggtctccagtggtggactcagaactggctgccctagagaagacctacaatacataccggtccaacaccctcacccgggtccagttcaagctggccctccactacttcaagaaccatctccaatgtgccgcataaaggtgtgagggcataggagaaacactaggctggctggttatggtatctatagcaggccaccaaaaactggactcctgataggtgaacgttgtaccaaaccagctggtgggtagggaaaagggaaatggctcagttactggaagtaccaatcaaaggtgaagggtcactggaaatgaaccagtcactgaccagggcaatggagactgtattaatagcaatgatgatttgtacaatgccctgccttttttgaagcatttgcat

SEQ ID NO: 670 - DNA, 3444 bp, Homo sapiens
atgccgcggctcccggtgaagaagatccgtaagcagatgaagctgctgctgctgctgctgctgctgagctgcgccgcgtggctcacctacgtgcacctgggcctggtgcgccagggacgcgcgctgcgccagcgcctgggctacgggcgagatggtgagaagctgaccagtgagaccgacggccggggggtccacgctgcgccatccacacagagggctgaggactccagtgagagccgtgaagaggagcaagcgcccgaaggtcgggacctagacatgctgtttcctgggggggctgggaggctgccactgaacttcacccatcagacacccccatggcgggaggagtacaaggggcaggtgaacctgcacgtgtttgaggactggtgtgggggcgccgtgggccacctgaggaggaacctgcacttcccgctgttccctcatacgcgcaccaccgtgaagaagttggccgtgtcccccaagtggaagaactatggactccgtatttttggtttcatccacccggcgagggacggagacgtccagttttctgtggcctcagacgacaactcggagttctggctgagtctggacgagagccctgctgctgcccagcttgtggcctttgtgggcaagactggctccgagtggacagcgcctggagaattcaccaagttcagctcccaggtgtccaagcccaggcggctcatggcctcccggaggtactactttgagttgctgcacaagcaggacgaccgcggctcggaccacgtggaagtgggctggcgagctttcctgcccggcctgaagttcgaggtcatcagctctgctcacatctccctgtacacagatgagtcagccttgaagatggaccacgtggcgcacgtcccccagtctccagccagccacgtgggggggcgtccgccgcaggaggagaccagcgcagacatgctgcggccagatcccagggatacctttttcctcactccacgcatggaatcttcgagcctggagaacgtgctggagccctgcgcctacgcccccacctacgtggtcaaggacttcccgatcgccagataccagggcctgcaatttgtgtacctgtccttcgtttatcccaacgactacactcgcctcacccacatggagacggacaacaagtgcttctaccgcgagtctccgctgtatctggagaggtttgggttctataaatacatgaagatggacaaggaggagggggatgaggatgaagaagacgaggtgcagcgccgagccttcctcttcctcaacccggacgacttcctggacgacgaggacgagggggagctgctcgacagcctggagcccaccgaggcggccccgcccaggagcggcccccagtcccccgccccagcagcccccgcccagcccggagccaccctcgccccgccgacccctccccgcccccgggacggggggacccccaggcactcccgggccctgagctgggccgccagggccgcccgccctttgccgctcttcttgggccgagctccgcccccgcgccctgcagtggagcagccgcccccaaaggtgtacgtgaccagggtgcggccgggacagcgggcatccccccgggccccagcgccgcgtgcgccctggccgcccttccctggcgtcttcctgcaccccaggcctctgcccagagtgcagctgcgggcgcccccacgcccaccccggccccacggccgcaggaccggcggcccccaggccacacagccgaggcccccagcccgggcgcaggccacccaagggggccgggagggccaggcgcgcacgctgggacctgcggcgcccacagtggactcaaacttgtcctccgaagcgcggcccgtgacctccttcctgagcttgtcccaggtgtccgggccgcagctgcccggggagggcgaagaggaggaggaaggggaggacgatggggccccgggcgacgaggccgcgtcggaggacagcgaggaggccgcgggcccggcgctcggacgctggcgtgaggacgccatcgactggcagcgcacgttcagcgtgggcgccgtggacttcgagctgctgcgctcggactggaacgacctgcgatgcaacgtttcggggaacctgcagctgccggaggcggaggccgtggacgtgaccgctcagtacatggagcggctgaacgcgcgccacggcgggcgcttcgcgcttctgcgcatcgtgaacgtggagaagcgccgggactcggcgcgagggagtcgcttcctgctggagctggagctgcaggagcgcgggggcggccgcctgcgactgtccgagtacgtcttcctgcggctgccgggagcccgcgtaggggatgcagacggagaaagtcccgaacccgctcccgccgcctccgtgcgccccgacggccgccccgagctctgccggccactgcgcctggcctggcgccaggacgtgatggttcacttcatcgtgccagtgaaaaaccaggcacggtgggtggcacagttcctggcggacatggctgcgctgcacgcgcgcaccggggactcgcgtttcagcgtcgtcctggtggatttcgagagcgaggatatggacgtggagcgggccctgcgcgccgcgcgcctgccccggtaccagtacctgagacgaaccgggaacttcgagcgctccgccgggctgcaggcgggagtggacgcggtagaggacgccagcagcatcgtgttcctctgcgacctgcacatccacttcccacccaacatcctggacggcatccgcaagcactgcgtggagggcaggctggccttcgcgcccgtggtcatgcgcctgagctgcgggagctcgccccgggacccccacggttactgggaggtgaacggctttggcctttttgggatctacaagtcggactttgaccgggttggaggaatgaacacggaggagttccgagaccagtgggggggtgaagactgggagctcctggacagggtcctgcaggcagggctggaggtggagcggctccgactgcggaatttctatcaccactaccactccaagaggggcatgtggagcgtccgcagcaggaagggctctcgcacgggggcgtcttgaggacgggcagcccctcccagccccggtgggagtcccgaggcagctgctgggggctgggctttgagctcggtcccgagagacccggcagggctggtcagaggggcacagccaccgcctgtgcctgcccctctctggcccactgggcgtcgtgcccctccccggagaggcagccttcacggcgggtcagggcctggccttggtccccactctgcgatgatttctgtgaaattttgctgtagcgatgacattgttttcagaatttccaagagttctgtctgttctgttttttattcagaatgaaatgaaatattttttttagttctg

SEQ ID NO: 671 - DNA, 1504 bp, Homo sapiens
cggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaatacagtggtctttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaatatattagtcgactgtgtta

SEQ ID NO: 672 - DNA, 2916 bp, Homo sapiens
ccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggtaagggcccacggtgtgcgtgtatcagtgccctgccctagcactacctgctgcagagcctgcagtgtctccttcagcactggtgcgggtgggtggtcaaatcaccacttctgtgtgatcttgctgggattcctcccttaggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaatgataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctggtgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatatgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagaactaa

SEQ ID NO: 673 - DNA, 2819 bp, Homo sapiens
atcgctagctgggggcggggccggaagctctttccccgcgactgcgccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaatgataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctggtgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatatgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagaact

SEQ ID NO: 674 - DNA, 4276 bp, Homo sapiens
gtttctcatagttggcgtcttctaaaggaaaaacactaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaagcaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaa

SEQ ID NO: 675 - DNA, 4278 bp, Homo sapiens
gtttctcatagttggcgtcttctaaaggaaaaacactaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttc

SEQ ID NO: 676 - DNA, 561 bp, Homo sapiens
gagctgcggccgaggctgggcgcgccgggcgccgggcgaagaagttggggcgaggcgggcagcgggggtcccgggggctgcagccgctacggggcccaggggcgccgcatctcgttccctgccgcagcggtctggccgggcgatggtggtttcgcctcagcggttcccagaagcttctcgggtggaagaaggatccagccagcctcccaaacttccaccgaaggttgacaccagcgccccggccccatgctccaggccgtggggggaacccgaggcgtggcggcaaatgcgtagagtcactcaacacgcactcggcctctttggaggtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcct

SEQ ID NO: 677 - DNA, 582 bp, Homo sapiens
aaccgaccgagggggtcgggggaggctgcgttaaggcttccctgagattggtttccttatcattttctccaccgccgctgtcccattttctgatgagtttgcttttaatgatttatccaacagtttgtcttgcagaagaagaagaccattgagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcct

SEQ ID NO: 678 - DNA, 1286 bp, Homo sapiens
ttagagatagtttttctcatcctcaagtattgggagtccaactttgagtggaatctggactaaacttcagagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggacccttgtgcccttggaaaacctcactccaagtagaggctgtatctggagtgagtgtctacagagaggggaattggtcagtgcatggcagaacttgacatggcagaactgttccgtgggccccagagcagggccgtgccgtgccttcctacttggtcatcctgtggctgtaggtgcactgtcccaactgctcacacaccttccagtcccctccctccattctcaccacagttacagtcggagcagggagagacaggacaccaagagacatgggcagggccacgtgtagtctggacagagcccacccagcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactaccttttttttttctggttttgccattcttttattcatgttgttacactcagtataggatagtttattaaaatcattatgtctgtagacattcta

SEQ ID NO: 679 - DNA, 2173 bp, Homo sapiens
aaaaagcttcttccatatggagggaccgggtgcgctgggcgcggcgtcccctgcgttgtcctcctgctgccgcccccgcggccgccgctttctgccgcggggaccctgagccccggcccgccggtgtcagccgccgcgcgcgcgcacagacacacacacagagacacacaaacacacacagaaaagacacacacgcgcacacacggcgcgcacaccctcacgcccgccacagccacaacacgcccgcacgcgccctccctctccggcccgcaacttctcggtcctcggctcctttgttgctccagccgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggacccttgtgcccttggaaaacctcactccaagtagaggctgtatctggagtgagtgtctacagagaggggaattggtcagtgcatggcagaacttgacatggcagaactgttccgtgggccccagagcagggccgtgccgtgccttcctacttggtcatcctgtggctgtaggtgcactgtcccaactgctcacacaccttccagtcccctccctccattctcaccacagttacagtcggagcagggagagacaggacaccaagagacatgggcagggccacgtgtagtctggacagagcccacccagcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactaccttttttttttctggttttgccattcttttattcatgttgttacactcagtataggatagtttattaaaatcattatgtctgtagacattctatttgtgatatagaaattgtgttatttctgacctctattttttcctattatgtgacaaagaacataggtcctcagaccaacatgtggaaaccaagggccaaatggcttctaaggtccctcccaactgaataattctggtaaattccatttccatgtgctcactgacggatggtcctaataaccgctcttatttcttttatgcttgtgaaagtcatagtttttacaaaattacttgagggtgtattataaagattcaacagagcaaagtaaaggccaagtgacttgacatagtcatagctggaagaggagccttaccaagacaggtgtttctagttgccattatacttattctaccttatgaggacccattgtatgaggctagatggaagtgagtaaacagacgtcctacctttg

SEQ ID NO: 680 - DNA, 544 bp, Homo sapiens
actaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtgggtgaggttttctcttcagtctgatagctctggcctattaggtcagccatttgttcatgttttgtgttaccacttagagatagtttttctcatcctcaagtattgggagtccaactttgagtggaatctggactaaacttcagagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttga

SEQ ID NO: 681 - DNA, 4638 bp, Homo sapiens
cctcctcctcctcctcgcacggtaatgggaggctcctaggcaggagaagcaaaagaaggaattgtttgcgagttcagtcatccaaaaagcttcttccatatggagggaccgggtgcgctgggcgcggcgtcccctgcgttgtcctcctgctgccgcccccgcggccgccgctttctgccgcggggaccctgagccccggcccgccggtgtcagccgccgcgcgcgcgcacagacacacacacagagacacacaaacacacacagaaaagacacacacgcgcacacacggcgcgcacaccctcacgcccgccacagccacaacacgcccgcacgcgccctccctctccggcccgcaacttctcggtcctcggctcctttgttgctccagccgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaa

SEQ ID NO: 682 - DNA, 1078 bp, Homo sapiens
ctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggggtctcactcagtcgcctacgctggagtgcaatgatgtacactgggagctttacctactgggtgcgatctatgctttccagacacaaactggacgccatcctgggcaggctgggctacacggccaccttggagtctgagttctcactggtccaggccatcagcaaagagaatgtcaagcagatggtgttcaagatcttcctggtgagggtctcatgtgaagccgttctcagaaccgcgggcacacggatgcttgagccgggcacagagaaactcgctaggacccacagcaggcacagctcagagaaaaggctggtgaagccctgcagctgcctcgagggggttcagccaggcccaggttccgggggaccacagcaaggtccctcagaaggggtggggtccgagacggccctggcagagggcactgctggccagagatctctgcccatggctctgagcccatctgaggtctcaacagcccccaacagcctccccagtggctctccagtcctctagggcccccagtgccatggcagcacatgcctggacagtgaggaggtcctgccttgcttcagtgaccctgtcttacactggatgccctggt

SEQ ID NO: 683 - DNA, 3190 bp, Homo sapiens
gcctgctgctgtgtgggtgtcgggctggctgtgcgcaaaggggcgcggctcggccctcccccgcacccgcgccccccgccccgcatctcggagtgacccgggccgcggcgccgcggtgctgaggcccgggagccgcgccgccgccgaggggggccggggccggtgacggtggcgtgggcggcggcgcggggacgacgggcggccgggcggggctgcggcagggcagggccagggccagggccggggcctgggaagccgccgccgccgctgcctcggcccgggatcgcgggcggctggtcggcccggctcgcctggccccgcctggcccgccccgccccgcccctgcgcgcccagcaggccgaagcgtagcggcgcgccccccgcgacgcccgagcccgagcgcagtggcctccgagcgggaaccggactgggagccggagccggggcgggaaccggagctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggcctaccacaaacacaaaacccacctgcaaaggtttcacggaacgtggagctctcctggcctcccgtccctcctcccggcctgtttgttgtgcctctgtagagagcgcttcggagagagaggcgaagtaggaagtgggattttctcttccctctcctgggcccgtttgcccctaccctcgcccagcaagctgcgcccaaattctattctgcctctggaaactgctggaccatccaaggtcagctgcctgccctgacccctaccccagggccagcttgtcctcctgggaggcgggacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggctgctcatagctggggatggtgagtggctgtgttctggccttgcccacgtgggtgtttgcagagacaaaatgaaggggatatgctccccataaataccaccttgccaccacaagaggaccagaaggctactcagccttgctgccacagaaggggatttgtagggtcagcctggctgcagaaaggctggctcagatcttgaccaagaaaccccagcgatttccatcaaagaccacgcaggtaacagaggtgattcctgaagacccagcccacagagggtggcagccaagcatctctgagcagtgtccctgctagcatcgccagcggccatcactctgcctccctcccacctcttgtccctcgtcgttaaaaaacagcaccctatcctgcttccccacatttctgttcctccaatgaagggctaagactatttagtaatctctttcttaagcagaggagtggcaaggatggcaatcttgaattttattttctgtagagatagcatttcttctggtgcggagctgaaaggaatccacccagaagttctgtagcatcctgcgtgcagcctcctggagccccagactccatctgggggagggacttgtttacaagcagttctgaccaccttagtggtgtactgttttctaggcaaaaaatatctgtctgttgtactgtatagcctttaaaatgcagtccaggaatgagactcttttaagaaacacatcctgcttctgcaattccagagagtgctgggggaaaaaaagggataaaaattcctacctactcatcagtgtttgaaagatggagctgaatagcttttcttgttcctggactaggcaatgaataagcaacaatgtatcttttctgtgttcaaaataaatacataatatcaataaaatgtagcaagaagtaacactttcagagagtgc

SEQ ID NO: 684 - DNA, 3297 bp, Homo sapiens
gcctgctgctgtgtgggtgtcgggctggctgtgcgcaaaggggcgcggctcggccctcccccgcacccgcgccccccgccccgcatctcggagtgacccgggccgcggcgccgcggtgctgaggcccgggagccgcgccgccgccgaggggggccggggccggtgacggtggcgtgggcggcggcgcggggacgacgggcggccgggcggggctgcggcagggcagggccagggccagggccggggcctgggaagccgccgccgccgctgcctcggcccgggatcgcgggcggctggtcggcccggctcgcctggccccgcctggcccgccccgccccgcccctgcgcgcccagcaggccgaagcgtagcggcgcgccccccgcgacgcccgagcccgagcgcagtggcctccgagcgggaaccggactgggagccggagccggggcgggaaccggagctggagccgaagctggagccggcactgcggcgcacggagcggagcgctgcagccaagccgagtgagtggaggggccttccctgcgagaagtcagagctgtgcccgtgggcaggctggctccgctgttctgctccaaggattacatgtccttcaaacgtccctgccccttagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggcctaccacaaacacaaaacccacctgcaaaggtttcacggaacgtggagctctcctggcctcccgtccctcctcccggcctgtttgttgtgcctctgtagagagcgcttcggagagagaggcgaagtaggaagtgggattttctcttccctctcctgggcccgtttgcccctaccctcgcccagcaagctgcgcccaaattctattctgcctctggaaactgctggaccatccaaggtcagctgcctgccctgacccctaccccagggccagcttgtcctcctgggaggcgggacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggctgctcatagctggggatggtgagtggctgtgttctggccttgcccacgtgggtgtttgcagagacaaaatgaaggggatatgctccccataaataccaccttgccaccacaagaggaccagaaggctactcagccttgctgccacagaaggggatttgtagggtcagcctggctgcagaaaggctggctcagatcttgaccaagaaaccccagcgatttccatcaaagaccacgcaggtaacagaggtgattcctgaagacccagcccacagagggtggcagccaagcatctctgagcagtgtccctgctagcatcgccagcggccatcactctgcctccctcccacctcttgtccctcgtcgttaaaaaacagcaccctatcctgcttccccacatttctgttcctccaatgaagggctaagactatttagtaatctctttcttaagcagaggagtggcaaggatggcaatcttgaattttattttctgtagagatagcatttcttctggtgcggagctgaaaggaatccacccagaagttctgtagcatcctgcgtgcagcctcctggagccccagactccatctgggggagggacttgtttacaagcagttctgaccaccttagtggtgtactgttttctaggcaaaaaatatctgtctgttgtactgtatagcctttaaaatgcagtccaggaatgagactcttttaagaaacacatcctgcttctgcaattccagagagtgctgggggaaaaaaagggataaaaattcctacctactcatcagtgtttgaaagatggagctgaatagcttttcttgttcctggactaggcaatgaataagcaacaatgtatcttttctgtgttcaaaataaatacataatatcaataaaatgtagcaagaagtaacactttcagagagtgc

SEQ ID NO: 685 - DNA, 798 bp, Homo sapiens
ctcagcgcctccgccccggggcccccgctcacccaggtatcgactccgcagccgggacgggtcctccagcccgagggaccttttcctcacgtcccacaacagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgtatata

SEQ ID NO: 686 - DNA, 2177 bp, Homo sapiens
cgccccctcaaccttcgcggggcgcgggccgcagcttttcggttcacagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgtatataccccctgcctccttctgttccagtcagccaacatatgtacataaaagaacacacaaattcaagaagttggaagattaaattatctgcttatttagtgtaggatggtcaggtagctagctataagtgaaaggaaattttgctgaagagactgagaaatgggtagtggaatgactatcaagatgacctcaaactatttaaaaacattttaacttgccatgaagaatcttgatgatttttgtataaatgttgtataaaattcttttacagctacagatttttaaataggatcattgtaaagattaatgagataatgttttaacatagtgcctggtccatgataagtgttaaatttttcaattaccctcagtaactgataatgtagcagaaaatactctatattcagacagacctgaatttgaatcccagctctatgacttatctgttgtgactttttttttttttttttttttgagacagggtctcgctctgtggcccaggctggagtgcagtggcacaatctcggctcactgcaaaccctacctcctgggctcaagtgatcctcctgcctcagcctcccgagcagctgggactacaggcacacaccaccacacccagctaatttttgtatttttgtagaggtagggttttgtcatgttgcccaggctggtctcgaactcctgggctcaggtgatctgcccgcctcgtcctgtcaaagtgctggaatacaggcatgagccaccatacccagcctatgctgtgactttagacaagttaggaaagtacctagcagagtacctgggacataagtaggttttctgtaaatgtttgtgacctttggctccgttgtgaggagagactgagcatacattactccacgctacaaataattaactatctatttgatttgactttcagtgtggagtgcagagctttttttctaaaagtgctaataaagccagtcctcattaaaaatatagtcagatgagtcagcaaagcaagttatttcaaaatttgaagaaatgagacaaaacaactttttgagtaatactataacctatgaaaatttggcagttagcaattgaaaaccttgtactttatcatctgtcccttaaccatggcctaccattgaggagaaaagattagagagcttgacataggccacaatgaagaggttctgaagagtcaaactattattgctttcatttcataaaccacactgttaaattcatttgtgtgtttggcatgggtgtgcacacatgtgtttcctaggttaagcatttaggaaaaacattatgaaatatgacatagacacaaaaaagtttattaaaaatttatgtga

SEQ ID NO: 687 - DNA, 645 bp, Homo sapiens
ccgggcctccagggcgcagcgttagatggcggtggcagcagcggcgcctgggcccctgaagcccggccgcacccgggccggagctcgcctcatactctccttcttagactaaccagaacatccaaagatcagcaacagtctcctccctcagcccccctccaacaggaggaggcggaggcggaggcgatggcgactcctccctctcctcgtcctggataccctccccgccaaccctttctcgcgagatgacgaccaccctggggactgaggctgccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggca

SEQ ID NO: 688 - DNA, 962 bp, Homo sapiens
gtcgtgaggcgggccttcgggctggctcgccgtcggctgccggggggttggccggggtgtcattggctctgggaagcggcagcagaggcagggaccactcggggtctggtgtcggcacagccatggcgggcgcgttggtgcggaaagcggcggactatgtccgaagcaaggatttccgggactacctcatgagtaagcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaataatttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaaa

SEQ ID NO: 689 - DNA, 962 bp, Homo sapiens
gtcgtgaggcgggccttcgggctggctcgccgtcggctgccggggggttggccggggtgtcattggctctgggaagcggcagcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaataatttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaaa

SEQ ID NO: 690 - DNA, 961 bp, Homo sapiens
gtcgtgaggcgggccttcgggctggctcgccgtcggctgccggggggttggccggggtgtcattggctctgggaagcggcagcagaggcagggaccactcggggtctggtgtcggcacagccatggcgggcgcgttggtgcggaaagcggcggactatgtccgaagcaaggatttccgggactacctcatgagtagcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaataatttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaaa

SEQ ID NO: 691 - DNA, 1904 bp, Homo sapiens
ggcgtggcctggatgcgcgggcgcccgggacggcacgtcctcagaccaaactacaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgccc

SEQ ID NO: 692 - DNA, 1907 bp, Homo sapiens
ggcgtggcctggatgcgcgggcgcccgggacggcacgtcctcagaccaaactacaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccacccccagctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgccc

SEQ ID NO: 693 - DNA, 1997 bp, Homo sapiens
ggcgtggcctggatgcgcgggcgcccgggacggcacgtcctcagaccaaactacaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccacccccagctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgccc

SEQ ID NO: 694 - DNA, 2164 bp, Homo sapiens
aaagaacgggtgggaatggtgtgggtgggggtcaaagaggaaacccagagatgcagggcgcccctttcccgtggtctgcccccaattgctcaggcaggccagtcacgggcacggaaagatctattcaactcactgcccaatctcctctcctggtgcagaaaagacacccagtcagcgacttgcattatctgcaggcatgagtgaataataataatgcctaacccttatatagtgctaattccacgcctggcactgttctaggcactcatataaattcatgtaatccacacaaccccaaaactgatgatatctcttcatcttaccaagcactgagcagttaaataacttgctccagatattaaggggtcgagctggggtttgaagcctggttacccataaatgaaccaagaactggaaggaggacaagagctccgagaaggagtcagatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgccc

SEQ ID NO: 695 - DNA, 6555 bp, Homo sapiens
gagcgcgccaaccttgccctagccggagcccgctgcggcccagcgcacggccctcaccccgcatcgcgaccccgcgccccgccggccgagcatgggcgcgcgcgcctcaggcgggcccctggcccgggccgggctcctgctgctgctgctgctgctgctgctgctcgggctgctggccccgggcgcgcagggggcgcggggccgcggcggcgcggagaagaacagctaccgccgcacggtcaacaccttctcccagagcgtcagcagcctgttcggcgaggacaacgtgcgcgccgctcagaagttcttggccaggctgactgagagatttgtgctgggagtggatatgttcgtggagacactgtggaaagtctggaccgagctcttggatgttcttggacttgacgtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaagtgaaggtcagccggccgggcgggtccacagttaccagcacgctgtctcagaaaacgaaaacggaggaaaaaaaccccaaaccccaaacaatcttaataaacacgactgagcaagaaagtggcgctgtgtagggctatttccacccacccggcagctcttaggacacattcccagaagagcggaaagatcattgacgtggaactacacacgaagtgtaattagtgggggaaaaaatattttttaaacaaaggatataaccatatttagttgtacagtaagagaaatttatctgtgcatagagcataaagttaattttttcaagcatttaaatacatcttttgtaaggttttttaataaaggcagattgagtcaagtttattaaaactttacatggaggggaagaatatgctaatttgacatttgagaaaagtttaaatgcgagcgtttgttttcacagcttagggattggtgggtgaggtctgtgtgcgttattttcatgttcccaaactgtgagctttatttcatgttatttttggtggatgttgacttagttcatgaatgttgtcacttctaaatgtggacagttgggctgcaggatgcaactcaacctcttttggatcctagagacccctgccaagcccccatcagtcctatttttaaatgaagacatcgccatttctagaagacctgagattttcttccctctgtgcttcgatgtattttaacctcaacattttgaaacggaaaatgcaaggaggggccaagaaatgtcctggggatttgatgccaggaagtacctggtaaggattggagattgctccagaatctactgcatgtcccaatttgcagtttgctcactagggctatatacaaaagctatacccttgagggtttttttttttttcttttgatttcctcaggaccttagagggaaaacaaacagtagcagctaatattctcaagtatattgctgcttagaaagatcctcaggaacaattagcagcaataagcaagcctttgaaaagatctgaattctttttcctgaaatatttacgatacacaggtgctttttatctgaaatctgttgtgtcctccttttaggcagtctctgtgggcagagagtgggacttgcgaggtggacagctgtggggatcctgggcaagggagtttcagaaggtgtggctcaggggctggtagaaacccccttttgttaggacttgttttttaaaaaagaaagccctaggccaggcgcagtggctgatgcctgtaatcccagcgctttgggaggccgaggagtatggatcacctgaggtcaggagttcaagaccagcctggccaacatggtgaaacccccgtctctactaaaaatacaaaaattagtcaggcatggtggtgggtgcctgtagtccagctactcaggaggctgaggcaggagaattgcttgaacctgggaggtggaggttgcggtgagccgagatcacgccactgcactccagcctaggcaacagagcaagacttcatcttaaaaaaaaaaaaaaaagcccagcattttgcagctttgaagctgctggggatcacgactgtctctgtggcccttacctggccacagatgtaccctggcaacccgctcacagtgccctgcgtgcaggtttatagataacccctgccagacctgctacaaccaagaccttatggtccaggtctcagtttggagaagatttagctgtctaccacttcttgtgtagtgttcctgtgaagttttatttttggttgcaagtatctggaaaacagatgcagatgtttttgtggatgttgttgagacttttgagacttctgtttctaaggtacacatgatgggacccaaactctcctggagagttccattcacttcctgaaacgtgcacctgtttcaggtgcatgtttattcagtgtgcatggatatttaagatttgctggagcaggctgggcagggtggctcacccctataatcccaacactttgggaggccaaggcaggtggatcacctgaggtcaggagtttgagaccagcccggccaacagagtgaaaccccgtctctactaaaaatacaaaaattagccaggcctggtggtgggcgcctgtgatcccagctacttgggaggctgaggctggagaatcgcttgaacatgggaggcggaggttgcagtcagctgagatcataccaccacactctagcctcagcaacagagtgagactccgtctcaaaaaaaattatttgctggatcgaatctttttttttttgagatggagtctcactgtcaaccaggctggagtgcagtggcaccatctcggctcactgcaagctccgcctcctgggttcacgccattctcctacctcagcctcccaagtagccgggactacaggcgcccaccatcatgcccggctaattttttatatttttagtagagacggggtttcaccgtgttagccaggatggtctcgatctcctgacctcgtgatccgcccgcctcggcctcccaaagtgctgggattacaggcgtgagccaccgcgctgggcctagatcaaatctttatccatgcacattggaacacaggattactgggttgaaatcattctagttttgtcatttagatacttgtagatgaatctattttagcacaaggtataaataactcgggaggtcatctctatcttctttccttttgtgcatttggctataccacgtttaggtactaaaacagctttgcttatgttggccaggggaaaacatggcattctgtgcgcaaagctaatgatcgccagccctgccttggcccctcccttgtttatggtcattgtaagatgcccgcatgttaaggcttaagctgtcactgggctgggtgtaatacccgcttcattcctcctcccaccctcttacccgaaacatgaagggcactgtgctctattgagatctcgataagatcatcattttaacttgtattcaactgagggaggtaacatgatatctgggtgctggtggattgagacctcaagcatcaattcaaaattgctgtcgaaaatatgcactattttttttttccactctggctaagtgtaggctctgaagccagttttatagcttgatacattctggtgaaagatgtcttcatttttaatgaaagaacctacagttagtaggtgtcacctcagggtagaaattctgatagaaattctgattatttgaaactctgatagaaatcctagatgctagatttgaagaaaacctgggttttattgcatagatttcaccttttctggggcacatcttaccccaaaataattggggatttttttgttccttctccattccatggaaccttgtagggtgttgggattgggcctcccctcgccacccgccacatgtctttgtttttttctctcttttgtatgtggaaaaatgtatttttgtaccatatctcatacctggagagaaaccttttttctatcttcagggctgtagaatatattagcgtaacacttcactgaatgtgacgtaaaagcattctgatgaaaactggttctgttataattaagactcagtgtttaaaatatcttaatcagtgttaatttcccagtgtttcagtatcacagtaaatacttgttttactgagaacagaaaataatccagaaaaggaaaaggaccagccctctctagattgctggaattgtatggatgtgttggggttggtttagtgatctcttccttgacaccctagcaaagatgcttttgtggagtgcaaacctttcataaatatactttccaggctgggtgcagtggctcaagcttgtaatcccagcactttgggaggccaaggcgggtggatcacttgcggtcgggagttcgagaccagcctggccaacatagtgaaatcccgtctctaccaaaaaatacaaaaaaaaaaaaaaaaaaaaaaatagccaggtgtggtggtgggttcctgtagtcccagctactcaggaggctgaggtgggagaattgtatgaacctgggaggcagaggttgcagtgaactgagatcacaccactgtactccagttgaggcgacagagtgagacccagtctcaaaaaaaaaaaaaagtgtgtgtgtgtgtatatatatgtatatatatatacacacacacacactttccaataccagtcggcattacccgccctttggtttcttttgctttggatttcagcccccatatcatttctggtaacagagcacagcaatagaatttctgggaagcagaccttgtgaatcgtgcctgtgtcttaattcacaaagggtaagtgaatgccgttgaaaggtgtttcatacacttaccccagaaatgagagcctgtctcatgcaggagtcgggaggcagcgatgtcagggaactgggactatgtctttatgactgtgatggtggtaaccaagtggggtggtcccctctggggagctgagtaagaacgcaaaggtttgggtcagtgattaggaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgaggctcctaaggggtcagctgccccactcctgacttttttatttttaatggtctataccttctgcaacatttttgtttatggccatttgaatagttggactttgactcctcacttgtgaataataggaatatattttgcagaatctaacataatacccttaaaattcatactggacaaccatcagtgtgatgtatagtatctggtgtaaacaaattttattcagcatattaaattattctgtgttttgcttttccttgatatgtaggaggtgcaccagtaccagtttttctcttgtggtggcttaaaacgctgattgccatttgcattgtctactgaaaagctgtggcagcgagtggtattattgaccatgtgttctcatgtctttttgcagatttaaaggttttattgtagtgtccatttaatatctgcatgtgtgtttaatctctgaataccatgtaattaaactgattaacttgtgatggtgatggtgattagcacacactaaaaacccaatgaagcaattgtctccctcttcttaactggaaatcacacttgtgaggtatggtatccattatcaacagtggattcatgattgacttcatattttgtgtatctggttataaattttgtatagcatttaatttggcacttaatataaatccatttgatttgaatagtgtgtgtgtgtacatggtgtgtgtgtgtgtgtgcactttagtttcgtgagccttgggaaactgattctacaaatatcttatatagagataaatgtatcaggcatttttttgcaaagcgatatatacattcctcttatttattaaatcactggctttggtgttatgtagagatatttgtagatctcagaacag

SEQ ID NO: 696 - DNA, 4124 bp, Homo sapiens
gaggccgccccactgcgccgagggccgccatcgctattgcggcattctccctcggctccggaggtaggggcaactcttctcttcctgtctgggaaaaagaccatagctcaaaaggaaggccgagggagaagttagaaagggatgatgaacgaagcgttttgaggggactgcaacgccgcggcaatacccgcccctgagctgcgcgcactaccgcctcggtagctatcatggccgccgggtcacgtgactccggcttggcgccgtcctggttttccgtcaccctggttctgtagtctcggttctccgactccctctttttctcgcttgtggactccgatatattgcccttcttcccttagaagaactgctgaaccgactctgagaaatttgaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagaaaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactattatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtggtttcaggtatgtttttcttttttctttttcttttttttttttctttttttttttttttttttttgaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttacttacaatttcattga

SEQ ID NO: 697 - DNA, 709 bp, Homo sapiens
gggtggtaaacaggaagtgggcgctcagagctcgggggcggcgctcagaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaa

SEQ ID NO: 698 - DNA, 1331 bp, Homo sapiens
aaacaggaagtgggcgctcagagctcgggggcggcgctcagaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagaaaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactattatattcagagggttatctgccttcagcttacttgttcttaatttttaatacagcggagatgtttcttgctttgttttcagactctccttttt

SEQ ID NO: 699 - DNA, 1508 bp, Homo sapiens
agagctcgggggcggcgctcagaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagaaaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactattatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtggtttcaggtatg

SEQ ID NO: 700 - DNA, 3198 bp, Homo sapiens
agacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaaactagc

SEQ ID NO: 701 - DNA, 2585 bp, Homo sapiens
ctggcaaaaaaaattactttgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 702 - DNA, 4388 bp, Homo sapiens
aattccagtcgttcgcttctgcttgacctctgagttctaatgtgggtccgggttaccaactgtcgtggattcgcacttattttgcctgggattcttccaacttaacctttttccttgaaccttagacatttcttacctaagagcctaaaggaaatcttgaggcttcagcagccaactcctgtccttccttagcaacaatcttaacaggagtgcacagggtaactggtttagggtgcttgctttgtcttaaggggaaaaacgacatttcccaggaggcaccgcgaaccaacgccggtacactatttcccagaattccagggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttatgggacacgagtgggtttggctggattctgaacaagatcatcccaatgactctgagttgagcaatgactgcaggtccctcttcagctcatgggactccagtctggatcttgatgtgggcaactggagggaaactgaggatccagaggctgaggaactagaggaaagcagcccggagagagaacctagtgaactgcttgttggggatggaggcagtgaggaatctcaggaagcggcaaggaaagccagccaccagaacctcctccactttctctctgaggtagcttatttaatggagcccttgtgcatcagcagcaacgaatcaagtgaaggctgctgccctccatctggtaccagacaagaaggaagggaaattaaagctagcgaaggagaaagggagctctgcagagagactgaagagctttcagctaaaggagaccccttagtagctgaaaagccactgggagaaaatggaaagccagaggtggcttcagctccctcagttatttgtacagttcagggactactcacagagagtgaagagggggaggctcagcaagaatccaaaggggaggaccagggtgaagtatatgtgtcagagatggaagaccagcccccttcaggcgagtgtgatgatgcctttaacattaaggagactcccttggtggatacacttttcagccatgctacctcctcaaagctgactgatctaagccaggatgaccctgttcaggatcatttgctatttaagaagactctcctgccagtctggaagatgattgccagtcacaggttcagcagtccatttctgaagcctgtgtcagaaaggcaggccccagggtacaaggatgtggtgaaaagacccatggacttaactagcctgaagagaaatctctctaagggtcggattcgcaccatggcccaattcctgcgagacctgatgctgatgttccaaaatgctgtaatgtacaatgactctgatcatcatgtataccatatggctgtggagatgcggcaagaagtcctggagcagattcaggtactgaatatctggttagacaaaagaaaaggctcaagtagtctggaaggagaaccagctaacccagtggatgatggaaaacctgttttctaacctggagctgctatcctgactttttctagagtttgaatctctcccggaactctgacctagagaggatcctggtacttctttgccatgtcctcattttcttttccaacaagaataataccttaactcacaaccaacgagtcaaagatgcatgtggacataatataaagaaaaaaaggggaagctgaggtttggatttatgccataaatgttgcccacatctttgttccatcggcttgatttaaagacaattccattagatcttttctaagccttttactctataaataaatgtatttacacaataggaa

SEQ ID NO: 703 - DNA, 2967 bp, Homo sapiens
gggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 704 - DNA, 2912 bp, Homo sapiens
ggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaaactagc

SEQ ID NO: 705 - DNA, 3005 bp, Homo sapiens
ggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaaactagc

SEQ ID NO: 706 - DNA, 2868 bp, Homo sapiens
gacttcggggccaagatggcgacgggaacgggcaaacacaagctgctaagcactggccccacagagccatggtccatccgagagaagctatgtttagcatcttctgtcatgagaagtggcgatcaaaattgcattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtg

SEQ ID NO: 707 - DNA, 5767 bp, Homo sapiens
ggttcggcaaggtttgcagccgccacggccgctgctgcgctccggtgcagggcaggctggcgccgagcgaaccagggccgggaactgggagccgggagccgggagccagctgcccgcggagctgcggcggcggcggcatctggggtggtctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggaaattttgagctggttagtttgctgttggagcgtggtgccgatcccctgataggaaccatgtacaggaatggaatttctacaaccccccagggtgatatgaactctttcagccaggctgcagcccacggacacaggaatgtgttccgcaaactgctcgcccagccagagaaggagaagagtgatatcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatgaaacgcctagtgcagggaatgcttcccgggaactttccagttctcctgccgcattggctttacacaaacacagacaaattccacctggcacctgtttttggctgggccaaggagctgcctctactgctcccacgtgttcctgttgaaaaacaaaggactttccactggtctgcagatcagatcagctgggtccagagtttaatgggcaactggacaaccaagttaaccccaattgaaagcacccctaggaccattgaacacccactgccggggaccactgtccagtgaatggattgaggccttttaaaggtcactcaggttccaggttgacagttggaggacttcaccgtaccaaccctgaagagattgtattacacattaaggaccttggtagctgtgcttcagcaaacgtcaaccatggtagcaaattggtgaggctgtgaccaataatgaggaaataatctggcaaatttttaggggtgggaacttttttaaatgttcatttaaaaaaaaacaaaaacagggcagtcttgtagtttaaaatatatttctaaaagcttaacagttcgttttcaactaaattgtgtttagggatctgtgtttgagatttttctttatttcttttttttttttaaatagtaagtcacaggtccacactgtgtaaacatgcatctgataagatactgctgatattctaaacaagttgaaataatcttgccttagtgatcatgattacacaaaagaggtgcactgccaataagtatctctaattcaatagttgaaagcaacctgcatgctaatcgtggtttcggggtgagaataaaacacccccacataacatgcatttgcatgggcccgaacctgtgaaatgttacgtttgtgcttcatttttgccaaggtaaaaatgttccatcatttctagctaaaactccatttggtgaaaccaacatatccatttcttttcctagttacggatgatttggggatgcttttgcagaaatgtgttcatagatgatgctgaatgggggaggggggcagcacgtcagagaatttactattaatcccagagttttctctgtattctcagaagatgttaatagtttgttactagccagagagtatgactatgttagattatttttaaagatgaaacatgtatgataggatggattctttctgtattctgagagtgtacagtacaggattattataatgaaagtttatatcaacagggtttcgttggctctgccatatattataagcaaaagagattggtaaagtgccacagtattccagataacttttcagttgcggcctttcttctcgttctttaatttgaaacctagatacatgcagtaaaaactaggagaatgacttttacccttggggacagccaagttttgttgataaacctatttcctagcatgccttcaggaagttgtgccagaccctagattgtgaaggacccactgttcttctgttgtacgagctccctgaaccattgttcagaggaccaatgtcacatcgcttcatgggcatggcccatggagcatctgggtgatatctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttctctgtcattaaaagaaatgattttcccaggc

SEQ ID NO: 708 - DNA, 4107 bp, Homo sapiens
aaagagctccagaaagacgacagggacgaggctgcagatgggaagggagtgctagcggacaccttaggcttgggtccacaatcagggagccccaaatagaaataacacggggcgctgattggttttccgccgctccagaccctgcgcttggtgcttcaagtgactcatccttatgttcacatgatcgccgagagggataatattcccagatcagttacctcctagcctttcctagtcacattatccccaggctacagatgaggaaactgaggcccaaggattccagagagcctgccccggggtcaccggtgcggtccggatgtctccaaaggctctcccactactctggaattcagaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggaaattttgagctggttagtttgctgttggagcgtggtgccgatcccctgataggaaccatgtacaggaatggaatttctacaaccccccagggtgatatgaactctttcagccaggctgcagcccacggacacaggaatgtgttccgcaaactgctcgcccagccagagaaggagaagagtgatatcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatgaaacgcctagtgcagggaatgcttcccgggaactttccagttctcctgccgcattggctttacacaaacacagacaaattccacctggcacctgtttttggctgggccaaggagctgcctctactgctcccacgtgttcctgttgaaaaacaaaggactttccactggtctgcagatcagatcagctgggtccagagtttaatgggcaactggacaaccaagttaaccccaattgaaagcacccctaggaccattgaacacccactgccggggaccactgtccagtgaatggattgaggccttttaaaggtcactcaggttccaggttgacagttggaggacttcaccgtaccaaccctgaagagattgtattacacattaaggaccttggtagctgtgcttcagcaaacgtcaaccatggtagcaaattggtgaggctgtgaccaataatgaggaaataatctggcaaatttttaggggtgggaacttttttaaatgttcatttaaaaaaaaacaaaaacagggcagtcttgtagtttaaaatatatttctaaaagcttaacagttcgttttcaactaaattgtgtttagggatctgtgtttgagatttttctttatttcttttttttttttaaatagtaagtcacaggtccacactgtgtaaacatgcatctgataagatactgctgatattctaaacaagttgaaataatcttgccttagtgatcatgattacacaaaagaggtgcactgccaataagtatctctaattcaatagttgaaagcaacctgcatgctaatcgtggtttcggggtgagaataaaacacccccacataacatgcatttgcatgggcccgaacctgtgaaatgttacgtttgtgcttcatttttgccaaggtaaaaatgttccatcatttctagctaaaactccatttggtgaaaccaacatatccatttcttttcctagttacggatgatttggggatgcttttgcagaaatgtgttcatagatgatgctgaatgggggaggggggcagcacgtcagagaatttactattaatcccagagttttctctgtattctcagaagatgttaatagtttgttactagccagagagtatgactatgttagattatttttaaagatgaaacatgtatgataggatggattctttctgtattctgagagtgtacagtacaggattattataatgaaagtttatatcaacagggtttcgttggctctgccatatattataagcaaaagagattggtaaagtgccacagtattccagataacttttcagttgcggcctttcttctcgttctttaatttgaaacctagatacatgcagtaaaaactaggagaatgacttttacccttggggacagccaagttttgttgataaacctatttcctagcatgccttcaggaagttgtgccagaccctagattgtgaaggacccactgttcttctgttgtacgagctccctgaaccattgttcagaggaccaatgtcacatcgcttcatgggcatggcccatggagcatctgggtgatatctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttctctgtcattaaaagaaatgattttcccaggc

SEQ ID NO: 709 - DNA, 3478 bp, Homo sapiens
aaggtttgcagccgccacggccgctgctgcgctccggtgcagggcaggctggcgccgagcgaaccagggccgggaactgggagccgggagccgggagccagctgcccgcggagctgcggcggcggcggcatctggggtggtctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatga

SEQ ID NO: 710 - DNA, 4614 bp, Homo sapiens
atggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggaaattttgagctggttagtttgctgttggagcgtggtgccgatcccctgataggaaccatgtacaggaatggaatttctacaaccccccagggtgatatgaactctttcagccaggctgcagcccacggacacaggaatgtgttccgcaaactgctcgcccagccagagaaggagaagagtgatatcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggaggtaagggatccattgtggtgttggctatcataggtcccttgggtgagtggcacttctgtaaactcgggtcaccagcctgcatggaagtgtctggaaggacccgtgttgggttttcatttggatgaagacttggggctcttgttccttcctgactcctcagtcctcccaaacaggaagggcttctcatcagagaccttccctggcaggctggggtgctagtgcacttgcttgcctgactgcttttagtagccactgagtgaaacccaattttaactggcattggtggtaagggggcagggaagggaaggaatttgactgaaaagtctgaggctacagctgaggcgttaatagtgatatcatcaggaaatatcctagatgacgtcttctcccttgtcactaataaaagaattatatcccctaaaaacatccctcaaatcacaacactgtctgttcttccaagatatagaagctgagggcagattacagtctcctcctggctttcctcaaactgagcatcccacagtcatgaagcccacgcctgcttccttcactctccccagccccctgtctgcctcttgtaattcaactggttctagccccgcctgtctaggagtcttgtttctgcctgcttttgtccaaagccaagattttcccctgttccttgccaaaagtggaaatcttgttcattttcctaattgaaactgggagctttgaaccagaagccaaaaatcacccccaattaatcctcagcaaaagagccaggatctcggtcagttatctgacgtctggggggtacctggctgatgagagatgtcaggacacaatcaactgttcaagagcagacctcacacagtggttacaacacggaagctgggccagactagtctaaatccaggctccactgcttctgagctgtgtgactgtggacaagttatttaacctcatatcctcagcttccttacccataaaatggggataactatctacctcactgggttttttagaggatcttaaaatatgctaaggtgcttagaacagtgcctggcacacagtgatcgccaataggactatgtattcactgcaggcccacttatcctttcttcctattctgtgaaaccttccgtggtcactctctccccacccaaacacacacatggacacacagtgactctcttgtctccctggactactcctctgatggttttagtctcgaggatgtgggcttatttgtaaacaaaagtgcgctggtgtttacaactaatttttgtgtgtgtgtgaaacagtctcactctgcccccaggctggagtgcagtggtgcaatttcggctcactgcaacctctgcctcctgggttcacaccattctcctgcctcggcctcccgagtagctaggattacaggcacctgccaccacacccagctaatttgttgtatttttagtagagacggggtttcaccatgttggccagatggtctcgaactcctgacctcagcctcccaaagtgttgggattacaggcatgagccactgcacacggctgtttacaactaactgatcacaaccagttatggatttctgtattccttctccactcccactgcttcatttgtctagccttaacaaaa

SEQ ID NO: 711 - DNA, 811 bp, Homo sapiens
agcgtttgtctcgttaatggagaacacagtcacaggatcaaaagggctaatttcaggataattctcctgaaatcctgctaatttcaggataattcactgcttccagaattttagagtactggtaaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatga

SEQ ID NO: 712 - DNA, 2229 bp, Homo sapiens
tagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaaggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaa

SEQ ID NO: 713 - DNA, 2071 bp, Homo sapiens
agagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaa

SEQ ID NO: 714 - DNA, 1600 bp, Homo sapiens
agtcacacccttcacagtgaaatgtatttgacggggctgggtgcagtggctcaagcccgtaatcccaacaccttgagaggctgagacaggaggattgcttgagtccaggagctcgagaccagcctgggcatatgcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagt

SEQ ID NO: 715 - DNA, 1512 bp, Homo sapiens
ggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtgctcctcaagatcgaatgaagtaactgatgtggacatggtttgtcaaatcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacat

SEQ ID NO: 716 - DNA, 1717 bp, Homo sapiens
gtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaaactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcag

SEQ ID NO: 717 - DNA, 1260 bp, Homo sapiens
gtttccatgccgtgaggtccattcacagaacacatccatggctctcatgctcagtttggttctgagtctcctcaagctgggatcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcag

SEQ ID NO: 718 - DNA, 3500 bp, Homo sapiens
agagcaaacggcatatatcttagggtggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtggcccccactgctgacgagagatggtggacctctcagtctccccagactccttgaagccagtatcgctgaccagcagtcttgtcttcctcatgcacctcctcctccttcagcctggggagccgagctcagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaagagaaactcactgcagagctggaaaagcttcagacagagcttgactggagacgggctgaaggccaggctgagtggagagcagcccaaaaatatgcagtggatgtgacgctggacccggcctcggcgcaccccagcctggaggtgtcggaggatggcaagagcgtgtcttcccgcggggcgccgccaggcccggcgcctggccacccgcagcggttctcggagcagacgtgcgcgctgagcctggagcggttctccgccggccgccactactgggaggtgcacgtgggccgccgcagccgctggttcctgggcgcctgcctggccgcggtgccgcgcgcggggcctgcgcgcctgagccctgcggccggctactgggtgctggggctgtggaacggctgcgagtacttcgtcctggccccgcaccgcgtcgcgctcaccctgcgcgtgcccccgcggcgcctgggcgtcttcctggactacgaggccggagagctgtccttcttcaacgtgtccgacggctcccacatcttcaccttccacgacaccttctcgggcgcgctctgtgcgtacttcaggcccagggcccacgacggcggcgaacatccggatcccctgaccatctgcccgctgccggttagagggacgggcgtccccgaagagaacgacagtgacacctggctacagccctatgagcccgcggaccccgccctggactggtggtgaggcgccctcgtggccgcgggactggccccggggggccccctggatcccaggccagcgctttgctctcctgctccgtctgaagggagcaggtgcaccagccaaaatgtcagcgagggggacaaagagagggacctttgcctacgtagatgtgtatgtgtagtgcgattttcttcaaggaaaggagacaagtccaaagctcgtttgtggattgtgggactgagcgaaggagtacaaatatatccacgtcgctcagagctggggtgctcacggtgggcggtgggcaagaagccagcatggaagaaagaagggagaaaactttggtgactgccttagagggatcagttaatttgtatagttttatattttttgtatatgtttgctagctctaaaaaggtcgagatgcaataacacttcgtaagcaacgagttcacctaagtaaggctcagatcctagttttaaaaaccatttcccattaaaatgaagttggaggaacagctgcttctggagccggggcaaaaatttcaaggtgagcctggagcattgtgtgtggtgaagtaaaataaaggctcaaaacgtgacggcaacccggcaaaagggtagggagccaggccgaaggggcctcactgaccaattgtgggacaatttgaacatcaggatgaataatgacaggagagattataacacactgaataaaaacataatccatgagttcatgctgatactcaaatttctttttaaaaaggagaaacaggaaggtttcttttggaggtgaaatctaattattggtgagagtcttggagaacaggctgtttccagtctcaaagcagtaaccttatacactacttataagtttgaaaggggaaaggttacctttacaatggagacatctaccagatcatccaagtgattaaatttaacatcatcaatgatgggaccaaggacattattagtttgacaactggggaaagaagtgttcttcaccccctacccccaagacattgtctctgtcggccaggctggagtgcagcctcaacctcctgggtccaagtgatcctcccacctcagcacacaacaccatgcccaattttaagtgcgttatagagacgggggtctcactttgttacccaggctggtctcaaactcctgcgctcaagcaatcctcccacctgggcctcccaaaatgctgggtgtacaggcatgagccgctgtgcctggcttcattttcagagtgagacatttgtactgtggctatgtaggagaacattcttgttcttagcaaacatactgaagtttttagatattaattaccacagtgtctgccactgaatttccagtgactaagtggaaaaatataaaacatatgaatataaagaaagaaagagacaagtcaaatgtagtaaaatgacaacacttggtgactctaggtgactggtcgacagatgttcattgtactatcaatgtggctttgctgtgggtttgaaattttgcaaactaagagttgggtggcggggagaaggatacaccaaaaaactaagtgattatctttggatgggaaaatgtttggtaattgcattcttaaaatgtcttctttgtattttttaatgttcaataatgtatatgtatcagttctgtaataaaggggaaaacactttttttaaata

SEQ ID NO: 719 - DNA, 1626 bp, Homo sapiens
agagcaaacggcatatatcttagggtggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtggcccccactgctgacgagagatggtggacctctcagtctccccagactccttgaagccagtatcgctgaccagcagtcttgtcttcctcatgcacctcctcctccttcagcctggggagccgagctcagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaagagaaactcactgcagagctggaaaagcttcagacagagcttgactggagacgggctgaaggccaggctgagtgcttcgttttagccagccaccctcctggagaaggtatccaggctgcctctaactccacaacaacactgaatgcatagtctcaaacgtgttgccttacggcgctgtgtggagatttctctggggtttgcaacctctgaatgctgagaagattgagcatctctgtatatgctagttggctctggggacttcctctactgaaaattgccagctcacatcactgacccatttttcttatgggatggctgtcttttattattaacaggaatattatatatctgtgtgtgtgtgtgtgtgtgtgtgtgtgtgtgtgtgagattaatccctcatgggtaaacatcgtgaattccttcttctgttgtgccatctgccattagctttgtccatagttccccttattgaaaaggaattattaattttgataaaacataatccatcaa

SEQ ID NO: 720 - DNA, 3498 bp, Homo sapiens
agagcaaacggcatatatcttagggtggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtggcccccactgctgacgagagatggtggacctctcagtctccccagactccttgaagccagtatcgctgaccagcagtcttgtcttcctcatgcacctcctcctccttcagcctggggagccgagctcagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaaggcaccgagaaaacagcccagttacctcccaaccaggttgcttcagactggagacgggctgaaggccaggctgagtggagagcagcccaaaaatatgcagtggatgtgacgctggacccggcctcggcgcaccccagcctggaggtgtcggaggatggcaagagcgtgtcttcccgcggggcgccgccaggcccggcgcctggccacccgcagcggttctcggagcagacgtgcgcgctgagcctggagcggttctccgccggccgccactactgggaggtgcacgtgggccgccgcagccgctggttcctgggcgcctgcctggccgcggtgccgcgcgcggggcctgcgcgcctgagccctgcggccggctactgggtgctggggctgtggaacggctgcgagtacttcgtcctggccccgcaccgcgtcgcgctcaccctgcgcgtgcccccgcggcgcctgggcgtcttcctggactacgaggccggagagctgtccttcttcaacgtgtccgacggctcccacatcttcaccttccacgacaccttctcgggcgcgctctgtgcgtacttcaggcccagggcccacgacggcggcgaacatccggatcccctgaccatctgcccgctgccggttagagggacgggcgtccccgaagagaacgacagtgacacctggctacagccctatgagcccgcggaccccgccctggactggtggtgaggcgccctcgtggccgcgggactggccccggggggccccctggatcccaggccagcgctttgctctcctgctccgtctgaagggagcaggtgcaccagccaaaatgtcagcgagggggacaaagagagggacctttgcctacgtagatgtgtatgtgtagtgcgattttcttcaaggaaaggagacaagtccaaagctcgtttgtggattgtgggactgagcgaaggagtacaaatatatccacgtcgctcagagctggggtgctcacggtgggcggtgggcaagaagccagcatggaagaaagaagggagaaaactttggtgactgccttagagggatcagttaatttgtatagttttatattttttgtatatgtttgctagctctaaaaaggtcgagatgcaataacacttcgtaagcaacgagttcacctaagtaaggctcagatcctagttttaaaaaccatttcccattaaaatgaagttggaggaacagctgcttctggagccggggcaaaaatttcaaggtgagcctggagcattgtgtgtggtgaagtaaaataaaggctcaaaacgtgacggcaacccggcaaaagggtagggagccaggccgaaggggcctcactgaccaattgtgggacaatttgaacatcaggatgaataatgacaggagagattataacacactgaataaaaacataatccatgagttcatgctgatactcaaatttctttttaaaaaggagaaacaggaaggtttcttttggaggtgaaatctaattattggtgagagtcttggagaacaggctgtttccagtctcaaagcagtaaccttatacactacttataagtttgaaaggggaaaggttacctttacaatggagacatctaccagatcatccaagtgattaaatttaacatcatcaatgatgggaccaaggacattattagtttgacaactggggaaagaagtgttcttcaccccctacccccaagacattgtctctgtcggccaggctggagtgcagcctcaacctcctgggtccaagtgatcctcccacctcagcacacaacaccatgcccaattttaagtgcgttatagagacgggggtctcactttgttacccaggctggtctcaaactcctgcgctcaagcaatcctcccacctgggcctcccaaaatgctgggtgtacaggcatgagccgctgtgcctggcttcattttcagagtgagacatttgtactgtggctatgtaggagaacattcttgttcttagcaaacatactgaagtttttagatattaattaccacagtgtctgccactgaatttccagtgactaagtggaaaaatataaaacatatgaatataaagaaagaaagagacaagtcaaatgtagtaaaatgacaacacttggtgactctaggtgactggtcgacagatgttcattgtactatcaatgtggctttgctgtgggtttgaaattttgcaaactaagagttgggtggcggggagaaggatacaccaaaaaactaagtgattatctttggatgggaaaatgtttggtaattgcattcttaaaatgtcttctttgtattttttaatgttcaataatgtatatgtatcagttctgtaataaaggggaaaacacttttttt

SEQ ID NO: 721 - DNA, 1266 bp, Homo sapiens
agagcaaacggcatatatcttagggtggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtggcccccactgctgacgagagatggtggacctctcagtctccccagactccttgaagccagtatcgctgaccagcagtcttgtcttcctcatgcacctcctcctccttcagcctggggagccgagctcagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaagccaggtatgatgcccaggcaggacccctgctggttgcttcagactggagacgggctgaaggccaggctgagtgcttcgttttagccagccaccctcctggagaaggtatccaggctgcctctaactccacaacaacactgaatgcatag

SEQ ID NO: 722 - DNA, 5275 bp, Homo sapiens
gcggccgcccctctggctgctctgcctggtcgcgtgctggctcctgggcgccggggccgaagccgacttctccatcctggacgaggcgcaagtgctggcgagccagatgcggaggctggcggccgaggagctgggggtcgtcaccatgcagcggatattcaactcctttgtttacactgagaaaatctcaaatggagaaagtgaagtacagcagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggatggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatggaccatt

SEQ ID NO: 723 - DNA, 5322 bp, Homo sapiens
atggcccgccagccggaggaagaggagacggccgtggcccgggcgcggcggccgcccctctggctgctctgcctggtcgcgtgctggctcctgggcgccggggccgaagccgacttctccatcctggacgaggcgcaagtgctggcgagccagatgcggaggctggcggccgaggagctgggggtcgtcaccatgcagcggatattcaactcctttgtttacactgagaaaatctcaaatggagaaagtgaagtacagcagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggatggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatggaccatt

SEQ ID NO: 724 - DNA, 2873 bp, Homo sapiens
tgcccctccaccccagccagctcatgggccacgtggcctggcccagcctcagcacccagggccagtgaacagagccctggctggagtccaaacatgtggggcctggtgaggctcctgctggcctggctgggtggctggggctgcatggggcgtctggcagccccagcccgggcctgggcagggtcccgggaacacccagggcctgctctgctgcggactcgaaggagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaagtgcaagacatcaacgacaatccacccatttttccccttgggccctaccatgccaccgtgcccgagatgtccaatgtcgggacatcagtgatccaggtgactgctcacgatgctgatgaccccagctatgggaacagtgccaagctggtgtacactgttctggatggactgcctttcttctctgtggacccccagactggagtggtgcgtacagccatccccaacatggaccgggagacacaggaggagttcttggtggtgatccaggccaaggacatgggcggccacatgggggggctgtcaggcagcactacggtgactgtcacgctcagcgatgtcaacgacaacccccccaagttcccacagagcctataccagttctccgtggtggagacagctggacctggcacactggtgggccggctccgggcccaggacccagacctgggggacaacgccctgatggcatacagcatcctggatggggaggggtctgaggccttcagcatcagcacagacttgcagggtcgagacgggctcctcactgtccgcaagcccctagactttgagagccagcgctcctactccttccgtgtcgaggccaccaacacgctcattgacccagcctatctgcggcgagggcccttcaaggatgtggcctctgtgcgtgtggcagtgcaagatgccccagagccacctgccttcacccaggctgcctaccacctgacagtgcctgagaacaaggccccggggaccctggtaggccagatctccgcggctgacctggactcccctgccagcccaatcagatactccatcctcccccactcagatccggagcgttgcttctctatccagcccgaggaaggcaccatccatacagcagcacccctggatcgcgaggctcgcgcctggcacaacctcactgtgctggctacagagctcggctggagctgggggccagaaaggggctgggtacctcttctggttgctgagtggagtgcaccagcagccccaccccagagaagccctgttggaagcgctgtgggaatcccccaagacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagagatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgca

SEQ ID NO: 725 - DNA, 3552 bp, Homo sapiens
ttctcgccggggccgctcagacctgcagcggagccgcggcgcccgctccaatcggctcggggctgtgcccccgggacccggcgacgggggcgggcgggggcgcttcccgccggcctgggcccctcggcagtgccaggtgtggatccatggggtagcctcaacgcatctgcccctccaccccagccagctcatgggccacgtggcctggcccagcctcagcacccagggccagtgaacagagccctggctggagtccaaacatgtggggcctggtgaggctcctgctggcctggctgggtggctggggctgcatggggcgtctggcagccccagcccgggcctgggcagggtcccgggaacacccagggcctgctctgctgcggactcgaaggagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaagtgcaagacatcaacgacaatccacccatttttccccttgggccctaccatgccaccgtgcccgagatgtccaatgtcgggacatcagtgatccaggtgactgctcacgatgctgatgaccccagctatgggaacagtgccaagctggtgtacactgttctggatggactgcctttcttctctgtggacccccagactggagtggtgcgtacagccatccccaacatggaccgggagacacaggaggagttcttggtggtgatccaggccaaggacatgggcggccacatgggggggctgtcaggcagcactacggtgactgtcacgctcagcgatgtcaacgacaacccccccaagttcccacagagcctataccagttctccgtggtggagacagctggacctggcacactggtgggccggctccgggcccaggacccagacctgggggacaacgccctgatggcatacagcatcctggatggggaggggtctgaggccttcagcatcagcacagacttgcagggtcgagacgggctcctcactgtccgcaagcccctagactttgagagccagcgctcctactccttccgtgtcgaggccaccaacacgctcattgacccagcctatctgcggcgagggcccttcaaggatgtggcctctgtgcgtgtggcagtgcaagatgccccagagccacctgccttcacccaggctgcctaccacctgacagtgcctgagaacaaggccccggggaccctggtaggccagatctccgcggctgacctggactcccctgccagcccaatcagatactccatcctcccccactcagatccggagcgttgcttctctatccagcccgaggaaggcaccatccatacagcagcacccctggatcgcgaggctcgcgcctggcacaacctcactgtgctggctacagagctcggctggagctgggggccagaaaggggctgggtacctcttctggttgctgagtggagtgcaccagcagccccaccccagagaagccctgttggaagcgctgtgggaatcccccaagacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagagatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgcagttctgaagctcacacatagtctccctgcgtcttccttgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccagacctgcctgcatggttccatccattactcatggcctcagcctcatcctggctccactggcctccagctgagagagggaaccagcctgcctcccagggcaagagctccagcctcccgtgtggccgcctccctggagctctgcccagctgtcagcttcccctgggcatcccagccctgggcattgtcttgtgtgcttcctgagggagtagggaaaggaaagggggaggcggctggggaaggggaaagagggaggaaggggaggggcctccatctctaatttcataataaacaaacactttattttgtaaagctgg

SEQ ID NO: 726 - DNA, 2037 bp, Homo sapiens
ttctcgccggggccgctcagacctgcagcggagccgcggcgcccgctccaatcggctcggggctgtgcccccgggacccggcgacgggggcgggcgggggcgcttcccgccggcctgggcccctcggcagtgccaggtgtggatccatggggtagcctcaacgcatctgcccctccaccccagccagctcatgggccacgtggcctggcccagcctcagcacccagggccagtgaacagagccctggctggagtccaaacatgtggggcctggtgaggctcctgctggcctggctgggtggctggggctgcatggggcgtctggcagccccagcccgggcctgggcagggtcccgggaacacccagggcctgctctgctgcggactcgaaggagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaaatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgcagttctgaagctcacacatagtctccctgcgtcttccttgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccagacctgcctgcatggttccatccattactcatggcctcagcctcatcctggctccactggcctccagctgagagagggaaccagcctgcctcccagggcaagagctccagcctcccgtgtggccgcctccctggagctctgcccagctgtcagcttcccctgggcatcccagccctgggcattgtcttgtgtgcttcctgagggagtagggaaaggaaagggggaggcggctggggaaggggaaagagggaggaaggggaggggcctccatctctaatttcataataaacaaacactttattttgtaaagctgg

SEQ ID NO: 727 - DNA, 3438 bp, Homo sapiens
ttctcgccggggccgctcagacctgcagcggagccgcggcgcccgctccaatcggctcggggctgtgcccccgggacccggcgacgggggcgggcgggggcgcttcccgccggcctgggcccctcggcagtgccaggtgtggatccatggggtagcctcaacgcatctgcccctccaccccagccagctcatgggccacgtggcctggcccagcctcagcacccagggccagtgaacagagccctggctggagtccaaacatgtggggcctggtgaggctcctgctggcctggctgggtggctggggctgcatggggcgtctggcagccccagcccgggcctgggcagggtcccgggaacacccagggcctgctctgctgcggactcgaaggagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaagtgcaagacatcaacgacaatccacccatttttccccttgggccctaccatgccaccgtgcccgagatgtccaatgtcgggacatcagtgatccaggtgactgctcacgatgctgatgaccccagctatgggaacagtgccaagctggtgtacactgttctggatggactgcctttcttctctgtggacccccagactggagtggtgcgtacagccatccccaacatggaccgggagacacaggaggagttcttggtggtgatccaggccaaggacatgggcggccacatgggggggctgtcaggcagcactacggtgactgtcacgctcagcgatgtcaacgacaacccccccaagttcccacagagcctataccagttctccgtggtggagacagctggacctggcacactggtgggccggctccgggcccaggacccagacctgggggacaacgccctgatggcatacagcatcctggatggggaggggtctgaggccttcagcatcagcacagacttgcagggtcgagacgggctcctcactgtccgcaagcccctagactttgagagccagcgctcctactccttccgtgtcgaggccaccaacacgctcattgacccagcctatctgcggcgagggcccttcaaggatgtggcctctgtgcgtgtggcagtgcaagatgccccagagccacctgccttcacccaggctgcctaccacctgacagtgcctgagaacaaggccccggggaccctggtaggccagatctccgcggctgacctggactcccctgccagcccaatcagatactccatcctcccccactcagatccggagcgttgcttctctatccagcccgaggaaggcaccatccatacagcagcacccctggatcgcgaggctcgcgcctggcacaacctcactgtgctggctacagagctcgacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagagatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgcagttctgaagctcacacatagtctccctgcgtcttccttgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccagacctgcctgcatggttccatccattactcatggcctcagcctcatcctggctccactggcctccagctgagagagggaaccagcctgcctcccagggcaagagctccagcctcccgtgtggccgcctccctggagctctgcccagctgtcagcttcccctgggcatcccagccctgggcattgtcttgtgtgcttcctgagggagtagggaaaggaaagggggaggcggctggggaaggggaaagagggaggaaggggaggggcctccatctctaatttcataataaacaaacactttattttgtaaagctgg

SEQ ID NO: 728 - DNA, 2759 bp, Homo sapiens
tgcccctccaccccagccagctcatgggccacgtggcctggcccagcctcagcacccagggccagtgaacagagccctggctggagtccaaacatgtggggcctggtgaggctcctgctggcctggctgggtggctggggctgcatggggcgtctggcagccccagcccgggcctgggcagggtcccgggaacacccagggcctgctctgctgcggactcgaaggagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaagtgcaagacatcaacgacaatccacccatttttccccttgggccctaccatgccaccgtgcccgagatgtccaatgtcgggacatcagtgatccaggtgactgctcacgatgctgatgaccccagctatgggaacagtgccaagctggtgtacactgttctggatggactgcctttcttctctgtggacccccagactggagtggtgcgtacagccatccccaacatggaccgggagacacaggaggagttcttggtggtgatccaggccaaggacatgggcggccacatgggggggctgtcaggcagcactacggtgactgtcacgctcagcgatgtcaacgacaacccccccaagttcccacagagcctataccagttctccgtggtggagacagctggacctggcacactggtgggccggctccgggcccaggacccagacctgggggacaacgccctgatggcatacagcatcctggatggggaggggtctgaggccttcagcatcagcacagacttgcagggtcgagacgggctcctcactgtccgcaagcccctagactttgagagccagcgctcctactccttccgtgtcgaggccaccaacacgctcattgacccagcctatctgcggcgagggcccttcaaggatgtggcctctgtgcgtgtggcagtgcaagatgccccagagccacctgccttcacccaggctgcctaccacctgacagtgcctgagaacaaggccccggggaccctggtaggccagatctccgcggctgacctggactcccctgccagcccaatcagatactccatcctcccccactcagatccggagcgttgcttctctatccagcccgaggaaggcaccatccatacagcagcacccctggatcgcgaggctcgcgcctggcacaacctcactgtgctggctacagagctcgacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagagatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgca

SEQ ID NO: 729 - DNA, 2870 bp, Homo sapiens
agaccccagccagtcttttgtgtacgtgcaggaccatggtggctttagtttctaccccacccttcctaggaactctacttgtggcaaacgtatgttcaagcttacaagtcagcccaccccactctgataaatgcaagaaaagctgaaaagggaggagcaagatgggatgaaagcatctgggccaaagtgacctgaaaacctttagagaagaagctgctggctgagaaggaggtgtgtggctccggtgagaccaccagcttggaggactggtcatcagctgcacgttctgggtctgtcttgggtattcccatatggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagtctaaagagagaaatcgcttcagcctcagcaggggctgcatcatcccccagggaagagccacagctgggcgaggattgccacaagacatttacaaggagatgatgccacggagactaacgcagactggtaaacggaaacacggggctttggctcgaacaccctctttcaagaaagttgtttatgaccacaaggaagatgaggagaacaaggctgggagaaagcaaaggagccacttgtttaaggttatgcagctgagaaatgaacaaggtggggttcgagtccagagtgcgcattccccatcaccccttaacaaaaaggcatgtttcccaggagactacagaggagaatcggcaggtggtcacaattgcagggctgtctcaggctga

SEQ ID NO: 730 - DNA, 1931 bp, Homo sapiens
tggcaaggctaataagaaagcagcttttccaagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagtaaaagagttaggagcctttgaatgagtaagttctgattagattttatctttaaacaaaaccacaaaatttaattggtttttacttgtccacttactgctagtgtcagtttcaggggaagaaatggtttcttttaaaaatcttaataggggacatatgccctaaaaatagtcagttttctagtctgagtaatagataagagactgactaagcaaagtttaaaatgctatttggacactttaatgcacatattggatatctaaaagtctacagccatataaaaattttatataattaatgagcaaatgccgtctctcatgccctaaaataaatcagtagaaacatgtttgctggtgaatcagtgaagcattatgttaaacagtgagttacagctcagagttaaaactttctccttctttttgaagaagctgtgcaaatacttctttttaaggagatctggccttttcctacctggttacctcagtcttcctctgctttgggaagctgaaaaagaagaaaaatcacatttaaagcactggaatgtctgaatgggacgcttgaatgtgtagaacagctgtactgatcctagcatgactcagaggacagtctagggcattttctgggtaattcaggataaaagtatttttttttttaagaaaaatacatgtttttggacaacaaaacaaagtaaacattagtttattcgat

SEQ ID NO: 731 - DNA, 3182 bp, Homo sapiens
agtcttttgtgtacgtgcaggaccatggtggctttagtttctaccccacccttcctaggaactctacttgtggcaaacgtatgttcaagcttacaagtcagcccaccccactctgataaatgcaagaaaagctgaaaagggaggagcaagatgggatgaaagcatctgggccaaagtgacctgaaaacctttagagaagaagctgctggctgagaaggaggtgtgtggctccggtgagaccaccagcttggaggactggtcatcagctgcacgttctgggtctgtcttgggtattcccatatggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgtta

SEQ ID NO: 732 - DNA, 2494 bp, Homo sapiens
aataagaaagcagcttttccaagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagtaaaagagttaggagcctttgaatgagtaagttctgattagattttatctttaaacaaaaccacaaaatttaattggtttttacttgtccacttactgctagtgtcagtttcaggggaagaaatggtttcttttaaaaatcttaataggggacatatgccctaaaaatagtcagttttctagtctgagtaatagataagagactgactaagcaaagtttaaaatgctatttggacactttaatgcacatattggatatctaaaagtctacagccatataaaaattttatataattaatgagcaaatgccgtctctcatgccctaaaataaatcagtagaaacatgtttgctggtgaatcagtgaagcattatgttaaacagtgagttacagctcagagttaaaactttctccttctttttgaagaagctgtgcaaatacttctttttaaggagatctggccttttcctacctggttacctcagtcttcctctgctttgggaagctgaaaaagaagaaaaatcacatttaaagcactggaatgtctgaatgggacgcttgaatgtgtagaacagctgtactgatcctagcatgactcagaggacagtctagggcattttctgggtaattcaggataaaagtatttttttttttaagaaaaatacatgtttttggacaacaaaacaaagtaaacattagtttattcgattgcctccttatacttgcctctttcattctgtcccctgtagatttttaaaaaattatctcattttaaaactttattatttcattttaaataattgacatataataattgtacatatttagggggtacatagtcatgtttcaatacatttacagtgatcagatcagggtggttaacgtaatcattggctcaaacatttttcatttctttgtattggtacggagcattcaatatccatcccccttctagctatctaaaactatgtattattgttaactataggcaacatataatggtatagagtgctagaacgtattcctcctaggaataatttgctgtaattttgtatcctttaataaatctctccctatccctctttccccccacccttcccagctgctgtgtcctctgttctaccttctacttccgagataaacttggttttagcttcca

SEQ ID NO: 733 - DNA, 1669 bp, Homo sapiens
ccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagtctaaagagagaaatcgcttcagcctcagcaggggctgcatcatcccccagggaagagccacagctgggcgaggattgccacaagacatttacaaggagatgatgccacggagactaacgcagactggtaaacggaaacacggggctttggctcgaacaccctctttcaagaaagttgtttatgaccacaaggaagatgaggagaacaaggctgggagaaagcaaaggagccacttgtttaaggttatgcagctgagaaatgaacaaggtggggttcgagtccagagtgcgcattccccatcaccccttaacaaaaaggcatgtttcccaggagactacagaggagaatcggcaggtggtcacaattgcagggctgtctcaggctgagcagagagtacggtggaggggcatgggcctgctgttggcggtgagggccttggaaatggcttcctggaggagatggcaattatccaggtagacaagatgtgtgtgtgtgtgtgtgtgtgtgtgtgtgtgatcatgaagaagaaataatgtgcaaagccctggtcataaataacttttcctctgcaaactgtggatggcagttcaccatgtttctcaccactggcctggtcactgcttatccaatatgcatgtaagaattactttttctcttttttcccttctataaattctcatagaacttcctttaatgcattaaaaaagcaactagcatgttc

SEQ ID NO: 734 - DNA, 4068 bp, Homo sapiens
gcctccgtggcgaaggggacacaggtccctgcggatgtgatggcccagctatggctgtcctgcttcctccttcctgccctcgtggtgtctgtggcagccaacgtggccccgaagttcctagccaacatgacgtcagtgatcctgcctgaggacctgcctgtgggtgcccaggccttctggttggtagcggaagaccaggacaatgaccctctgacctatgggatgagcggccccaatgcctacttcttcgctgtcactccgaaaactggggaagtgaagctggccagcgctctggactacgagacactctacacattcaaagtcaccatctccgtgagcgacccctacatccaggtgcagagggagatgctggtgattgtggaagatagaaacgacaacgcacccgttttccagaacaccgctttctccaccagcatcaacgagaccctgcccgtgggcagtgtggtgttctccgtgctggccgtggataaagacatggggtctgcaggcatggtcgtgtactccatagagaaggtcatccctagcactggggacagcgagcatctcttccggatcctggccaatggctccatagtcctcaatggcagcctcagctacaacaacaagagcgctttctaccagctggagctgaaggcctgtgacttgggcggcatgtaccacaacaccttcaccatccagtgctccctgcctgtcttcctgtccatctccgtggtggaccagcctgaccttgacccccagtttgtcagggagttttactcggcctctgtggctgaggatgcagccaagggaacctcggtgctgacggtggaggctgtggatggcgacaaaggcatcaatgaccctgtgatctacagcatctcctactccacgcggcccggctggtttgacatcggggcagatggggtgatcagggtcaacggctccctggaccgtgagcagctgctggaggcggatgaggaggtgcagctgcaggtcacggccaccgagacacacctcaacatctacgggcaggaggccaaggtgagcatctgggtgacagtgagagtgatggacgtcaatgaccacaaacctgagttttacaactgcagcctcccagcctgcaccttcacccccgaagaggcccaagtgaacttcactggctacgtggacgagcatgcctccccccgcatccccatcgatgacctcaccatggtggtctacgacccggacaagggcagcaatggcaccttcctgttgtcgctggggggccccgatgcagaagccttcagcgtctccccggagcgggcagtgggctcagcctccgttcaggtgctggtgagagtatccgcgctggtggactacgagaggcagacggcgatggcggtgcaggttgtggccacagactccgtcagccagaacttctccgtcgccatggtgaccatccaccttagagacattaatgaccacaggcccacgtttccccagagcttgtacgtcctcacggtgccagagcacagcgccaccggctctgtggtcaccgacagcatccacgccacggacccagacacgggcgcgtggggccaaattacctacagcctgctcccaggaaatggggcagacctcttccaagtggatcccgtctcagggacggtgacggtgaggaacggtgagctgctggaccgggagagccaggccgtgtactacctgacgctgcaggccacagacggcgggaacctgtcctcctccaccacactgcagatccacctgctggacatcaacgacaatgcacccgtggttagcggctcctacaacatcttcgtccaggaggaggagggcaatgtctccgtgaccatccaggcccacgacaatgatgagccgggcaccaacaacagccgtctgctcttcaacctgctgcctggcccctacagccacaacttctccttggaccctgacacagggctcctcagaaacctggggcccctggacagagaggccatcgaccccgccctggagggccgcattgtgctgacagtgcttgtgtctgactgcggcgagcctgtcctcggcaccaaagtcaatgtcaccatcactgtggaggacatcaatgataacctgcccatcttcaatcagtccagctacaactttacggtgaaggaggaggatccaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcccccggacgtgagcctggattacgagacacagcccgtcttcaacttgacagtgagtgctgagaacccagacccccaggggggtgagaccatagtagacgtctgcgtgaatgtgaaagacgtgaacgacaatccccccaccctggatgtagcctcactccggggcatccgtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgctgccctgc

SEQ ID NO: 735 - DNA, 4005 bp, Homo sapiens
tccaggagccattccctgacctcttcccttaggtccctgcggatgtgatggcccagctatggctgtcctgcttcctccttcctgccctcgtggtgtctgtggcagccaacgtggccccgaagttcctagccaacatgacgtcagtgatcctgcctgaggacctgcctgtgggtgcccaggccttctggttggtagcggaagaccaggacaatgaccctctgacctatgggatgagcggccccaatgcctacttcttcgctgtcactccgaaaactggggaagtgaagctggccagcgctctggactacgagacactctacacattcaaagtcaccatctccgtgagcgacccctacatccaggtgcagagggagatgctggtgattgtggaagatagaaacgacaacgcacccgttttccagaacaccgctttctccaccagcatcaacgagaccctgcccgtgggcagtgtggtgttctccgtgctggccgtggataaagacatggggtctgcaggcatggtcgtgtactccatagagaaggtcatccctagcactggggacagcgagcatctcttccggatcctggccaatggctccatagtcctcaatggcagcctcagctacaacaacaagagcgctttctaccagctggagctgaaggcctgtgacttgggcggcatgtaccacaacaccttcaccatccagtgctccctgcctgtcttcctgtccatctccgtggtggaccagcctgaccttgacccccagtttgtcagggagttttactcggcctctgtggctgaggatgcagccaagggaacctcggtgctgacggtggaggctgtggatggcgacaaaggcatcaatgaccctgtgatctacagcatctcctactccacgcggcccggctggtttgacatcggggcagatggggtgatcagggtcaacggctccctggaccgtgagcagctgctggaggcggatgaggaggtgcagctgcaggtcacggccaccgagacacacctcaacatctacgggcaggaggccaaggtgagcatctgggtgacagtgagagtgatggacgtcaatgaccacaaacctgagttttacaactgcagcctcccagcctgcaccttcacccccgaagaggcccaagtgaacttcactggctacgtggacgagcatgcctccccccgcatccccatcgatgacctcaccatggtggtctacgacccggacaagggcagcaatggcaccttcctgttgtcgctggggggccccgatgcagaagccttcagcgtctccccggagcgggcagtgggctcagcctccgttcaggtgctggtgagagtatccgcgctggtggactacgagaggcagacggcgatggcggtgcaggttgtggccacagactccgtcagccagaacttctccgtcgccatggtgaccatccaccttagagacattaatgaccacaggcccacgtttccccagagcttgtacgtcctcacggtgccagagcacagcgccaccggctctgtggtcaccgacagcatccacgccacggacccagacacgggcgcgtggggccaaattacctacagcctgctcccaggaaatggggcagacctcttccaagtggatcccgtctcagggacggtgacggtgaggaacggtgagctgctggaccgggagagccaggccgtgtactacctgacgctgcaggccacagacggcgggaacctgtcctcctccaccacactgcagatccacctgctggacatcaacgacaatgcacccgtggttagcggctcctacaacatcttcgtccaggaggaggagggcaatgtctccgtgaccatccaggcccacgacaatgatgagccgggcaccaacaacagccgtctgctcttcaacctgctgcctggcccctacagccacaacttctccttggaccctgacacagggctcctcagaaacctggggcccctggacagagaggccatcgaccccgccctggagggccgcattgtgctgacagtgcttgtgtctgactgcggcgagcctgtcctcggcaccaaagtcaatgtcaccatcactgtggaggacatcaatgataacctgcccatcttcaatcagtccagctacaactttacggtgaaggaggaggatccaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcccccggacgtgagcctggattacgagacacagcccgtcttcaacttgacagtgagtgctgagaacccagacccccaggggggtgagaccatagtagacgtctgcgtgaatgtgaaagacgtgaacgacaatccccccaccctggatgtagcctcactccggggcatccgtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccc

SEQ ID NO: 736 - DNA, 4509 bp, Homo sapiens
aaagggggcaggaaccgtcacattgttcagtgatgaaaaccgagggctgcaggagtgcggaccctggaagatcgaggaagacaagtctacccgaatcccccactgtccctccatcttactcgtcctccttccctcacttcccagcccccggcaccagctcgactcgagcttagtggctttcaggcaacggaagctgtgtgaccttgggcaagacacggactctctccggaccccgcagcgttccgacatccagaatgcagtccctgcggatgtgatggcccagctatggctgtcctgcttcctccttcctgccctcgtggtgtctgtggcagccaacgtggccccgaagttcctagccaacatgacgtcagtgatcctgcctgaggacctgcctgtgggtgcccaggccttctggttggtagcggaagaccaggacaatgaccctctgacctatgggatgagcggccccaatgcctacttcttcgctgtcactccgaaaactggggaagtgaagctggccagcgctctggactacgagacactctacacattcaaagtcaccatctccgtgagcgacccctacatccaggtgcagagggagatgctggtgattgtggaagatagaaacgacaacgcacccgttttccagaacaccgctttctccaccagcatcaacgagaccctgcccgtgggcagtgtggtgttctccgtgctggccgtggataaagacatggggtctgcaggcatggtcgtgtactccatagagaaggtcatccctagcactggggacagcgagcatctcttccggatcctggccaatggctccatagtcctcaatggcagcctcagctacaacaacaagagcgctttctaccagctggagctgaaggcctgtgacttgggcggcatgtaccacaacaccttcaccatccagtgctccctgcctgtcttcctgtccatctccgtggtggaccagcctgaccttgacccccagtttgtcagggagttttactcggcctctgtggctgaggatgcagccaagggaacctcggtgctgacggtggaggctgtggatggcgacaaaggcatcaatgaccctgtgatctacagcatctcctactccacgcggcccggctggtttgacatcggggcagatggggtgatcagggtcaacggctccctggaccgtgagcagctgctggaggcggatgaggaggtgcagctgcaggtcacggccaccgagacacacctcaacatctacgggcaggaggccaaggtgagcatctgggtgacagtgagagtgatggacgtcaatgaccacaaacctgagttttacaactgcagcctcccagcctgcaccttcacccccgaagaggcccaagtgaacttcactggctacgtggacgagcatgcctccccccgcatccccatcgatgacctcaccatggtggtctacgacccggacaagggcagcaatggcaccttcctgttgtcgctggggggccccgatgcagaagccttcagcgtctccccggagcgggcagtgggctcagcctccgttcaggtgctggtgagagtatccgcgctggtggactacgagaggcagacggcgatggcggtgcaggttgtggccacagactccgtcagccagaacttctccgtcgccatggtgaccatccaccttagagacattaatgaccacaggcccacgtttccccagagcttgtacgtcctcacggtgccagagcacagcgccaccggctctgtggtcaccgacagcatccacgccacggacccagacacgggcgcgtggggccaaattacctacagcctgctcccaggaaatggggcagacctcttccaagtggatcccgtctcagggacggtgacggtgaggaacggtgagctgctggaccgggagagccaggccgtgtactacctgacgctgcaggccacagacggcgggaacctgtcctcctccaccacactgcagatccacctgctggacatcaacgacaatgcacccgtggttagcggctcctacaacatcttcgtccaggaggaggagggcaatgtctccgtgaccatccaggcccacgacaatgatgagccgggcaccaacaacagccgtctgctcttcaacctgctgcctggcccctacagccacaacttctccttggaccctgacacagggctcctcagaaacctggggcccctggacagagaggccatcgaccccgccctggagggccgcattgtgctgacagtgcttgtgtctgactgcggcgagcctgtcctcggcaccaaagtcaatgtcaccatcactgtggaggacatcaatgataacctgcccatcttcaatcagtccagctacaactttacggtgaaggaggaggatccaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcccccggacgtgagcctggattacgagacacagcccgtcttcaacttgacagtgagtgctgagaacccagacccccaggggggtgagaccatagtagacgtctgcgtgaatgtgaaagacgtgaacgacaatccccccaccctggatgtagcctcactccggggcatccgtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgctgccctgcctcctgcttttggccaatcacggcagacaggggttggggaaatattttattaccaatgtatactgtgacagtttgtagccaaaaactgcggctggaggggtggggacgggacactgagtggtcacaagggacttgggctcacagcacaggggggacaaggggctggagagggtggcctttaaaagacaactgtggttatagaatga

SEQ ID NO: 737 - DNA, 3813 bp, Homo sapiens
ctggaataaactttgggtgtgagacgggattcaggctgtggctaatgtgctggaagcacgcacagttgtgaccatcaagtatgcaggaagcaatcattctcctggctctcctgggtgccatgtcagggggagaagcactacacctaatcctcttacctgctacaggcaatgtggcagagaattctccacctgggacttcagtgcacaagttttctgtgaagttatcagcatcattgtcacctgtgatcccaggatttccccagatagtcaactcaaatcccctcactgaagcttttagggtgaattggctgtcaggcacctactttgaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaaggtctacacctctacatagtagaaagagcaaaccctggattcatttaccaggttgaggccttcgatccagaagacacaagccgaaacattcccctcagttatttcctgatttctcccccaaagagcttcagaatgtctgctaatggcaccctcttctccacaacagaattggactttgaagcaggacacagaagtttccatctcatcgtggaggtgagggacagtggaggcctcaaagcctccacagagctccaggtgaacatcgtgaacctcaacgacgaagtccctcgctttaccagcccgacacgagtgtacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtgctgattggtgatctagactacgaaaatccaagtaacctagcagccggcaataaatatacggtgataatccaggtgcaggatgtggcccccccttactataaaaataacgtctacgtttatatcctaacaagcccagaaaatgagtttcctctcatttttgataggccatcctatgtatttgatgtgtcagaaagaaggcccgccagaacccgagtgggacaggtgcgagccactgataaagacctcccccagagcagcctcctgtactccatctccactggaggggccagcctccagtatccaaatgtattttggattaatcccaagacaggagaactccagctggtaactaaagtggactgtgaaacaacccccatctatattctcagaatccaggccaccaacaacgaagacacaagctctgtcactgttactgtgaacatccttgaagaaaatgatgaaaagccaatttgtactccaaactcttatttcctggccctcccagtggatctgaaagttggcacaaatattcagaatttcaagctgacatgtaccgaccttgattccagccccagatctttccgttattccattggcccaggtaacgtcaacaatcatttcaccttctctcccaatgctggttccaatgtcacacgcctgctgcttacatctcgctttgactatgctggtgggtttgataagatctgggactacaagctacttgtctacgtaactgatgacaacttgatgtctgacaggaagaaagcggaggctcttgttgagacaggaacagtgacactgagtattaaagtcattccccacccaaccactatcatcaccacgacccccaggcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgacaaagaaaggagaaacgaagactgcagagagagacgtcgtggtggaaactatccagatgaacactatctttgatggagaagccatagatccagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagattttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacact

SEQ ID NO: 738 - DNA, 1188 bp, Homo sapiens
gctgtctgtgtcttcaggtcatcatggtgctgctcaggctcctcgtgttcctctttgctccggtggtctctgacctctgcagcctgccctgctttataaatgtctctgagagccagggccctggcacagtccttcagtttttatccttcaactgctcctcctacacgcccacacccaccctggagttgctcaatgtccagccacccaccaccttcttcaacccacccagcttggccaggtggcaagggacctatgtgggcaagttgaccttgagcagctctgctcagttggatgccctgatggtgaaccactacaaggtgcagctgaagttcacatgtggcaaccatgtgatggagggctcactctctgtggatgtgcagcgggaccttagccatatccagtgtgctggtcaatttgccagcccaggtgaggccaggggcagccggcagggtgggggcaggcatggcctgagcagatcctccctgacctccactctggccagctggggaaatgattcaggtgccagagacagtcacacctggggctcggctgtacactctgctcctcccaggcctagaactccacggagcgcaggtaagcccagaacatgggacggtgggtgacaggatgggggtggggggatggagagaataaattaacccccacctggccaggcacagcctgaagaggaaccttgcagcagaggcatagatgagcctctacatgatgtatgttcttggagagagctgctgagggctgctcactccccagtgaccatggctgttcccacagggacatctcaggggctgagttcttttttttttttttttttgagacggagtcttgctctgtcgtccaggctggagtgcagtggcgcgatctcggctcactgcaagctccacctcccaggttcatgccattctcctgcctcagcctcccgagtagctgggactacaggcacccgccaccacgcccggctaatttttttgtattttgtagtggagacagggtttcaccgtgttagccaggatggtctcgatctcctgacctcgtgatctccccacctcggcctcccaaagtgctgggattacaggcatgagccaccgctcccagccaggggctgagttctttcaagatctgctatgtgttctcagttctttatgacaattctgtatcatttctgtaatc

SEQ ID NO: 739 - DNA, 2476 bp, Homo sapiens
caggtcatcatggtgctgctcaggctcctcgtgttcctctttgctccggtggtctctgacctctgcagcctgccctgctttataaatgtctctgagagccagggccctggcacagtccttcagtttttatccttcaactgctcctcctacacgcccacacccaccctggagttgctcaatgtccagccacccaccaccttcttcaacccacccagcttggccaggtggcaagggacctatgtgggcaagttgaccttgagcagctctgctcagttggatgccctgatggtgaaccactacaaggtgcagctgaagttcacatgtggcaaccatgtgatggagggctcactctctgtggatgtgcagcgggaccttagccatatccagtgtgctggtcaatttgccagcccagctggggaaatgattcaggtgccagagacagtcacacctggggctcggctgtacactctgctcctcccaggcctagaactccacggagcgcagatgagcattatcagtgcccaggacctgccacacttccctggacctttctccatcaatgagcaaggttggctgcaggcaccatcccagggcctcctaggccaggctcaaaaggtcttccagctgcaaatctcagtgtcctttggacaaaggcaaagctgccaagggatggtgatagtgaaggttttgcctgttccctccagccaggtctccttcctcgagcaggctcagaatatcaccatccctgagaatctggcccccggtagtgaggtggttcaggtccaggcccggggtgtcgacctgcgctatgaaatcctgtctccggtgcccagcccactcttctccattggtcgtgcagacggtgtggtccggaccaccacgcccctagagttagctcgcacctcaggcaccgcggtctccaggctgcaggtgaaggcctttgagcagggccagctgtgggccagtgccaagctcaatctcaccatgaatgtgcagctggtcaacctctggcctccacgctgcctcccagcgcttctggtgtcccaaatcccggagactgcacccgtgggcaccgtgctgaatactctcacttgcgaagatccggactctgttggtgccaccctggactacaagctgtggttccgcagctcttccaaccctgccagcctctgcctttatgacagagtccttgaggtgaatgccacactggactgtgacactcctggagcctgcttccagcatgcagcctccatcctggtgctcgatggtggccagccccagatgaccactgaggtgccggtactggtgatggtgacacccatcaacgagttctccccagcctgtgcccctcgcacgttccgggttcaggaggatgcggcgccccacactctactgggctccgtggtgggcacggatatggattaccctcatgacaacattgagtactacacctctggtggtcctaccacctttgctgtggaccgtctcagcggggaagttcacctcctgggacctttggactatgagcagcagaggctgtacaggctcactgtccttgtgattgaccatggccaagaccagaaccccaaccatcacctctcaggctcctgtaccattaccatcgaggttgaggatgtgaatgaccatgcccccgagtgtgagcccccatttcaggaactcaccatctatgctcctctgggccgtagcgtggaggtgaccaagatgtcatgccagatccctcaggagccacagcgcctgatctactcctatagcatcgtgggagggaatagccagaaccgattcatcctgcaaggggccatcctggtgcacagtgaccttgtgttggggccgttctggccagagcagccccgtacctatgagctactgatctgtgtggccgatgcaggcccctccaccccccacctcagcaccacagccaccattattgtgcatctagttccccggagggccagcacagtggccaccagcacccacagaaccacagtgccctcaacgatgacacccatgctcgtgacagacacagaggctttctggcagccacagccctggtttgtggtggtgttgacagcaactggtgctcttctcctcttggccctaggctggcttcttggcaggctcctccaggggttggcccagctgctgcaagcacccagcaaaccagcccaggctttgctgctaaacagcatccagggaactgagggatccatcgagggtttcctggaggcaccgaagatggagatgtcccaggcacccagcagtgtcatgagtctgcattttgatggcagagcacaggactcccgtaccggaagagactacctgtttaacacacacacaggagcccggcgctggctctgaggccaagtagctgtcttactatgtgtggaatttctttttcacaccatcatgggctgtattttcaagttgattcataataaacaaaattacaaaaagaaaa

SEQ ID NO: 740 - DNA, 1369 bp, Homo sapiens
cggcaggcaccctggcttcgggaacccaaactagccagcttccctttctgggcctgctggcctaattcccagccgcagctgccattctgggcccccctccctgaggccatctccctgcagatttggcagcggggaaaggaggggccgagagaaggggagagaaccagagacaggactgagcgctaatctgatgtagatgatccggcagccttctccagcttggttcccctctgccatcagctctccaggtgactttccctgtgccctgcactctccccttctgctttcatctccttaagaaagtgcccagaaagttaaacccacacacaaacacacacacaatccacccaaaaaaaaaaaaaatcggagagcaggagcaggcagacgagtaagagagcacgcgcgcaagagagggctcacatccgtcctggaggaagaacggcacagacggagggaggctggggttggcagagactgggacggaagtccctcagtcccccaggagcctccttcatggacccggggatcccaagaggggctgcctcaacttaggatgggcaactgtgtcaagtatccactgagaaatctctcaaggaagatgtgccaggaggaacagaccagctacatggtggtgcagacgagcgaggaggggctggcggctgacgccgagctcccgggaccgctcctgatgctggcccagaactgcgcagtcatgcacaacctgctgggccctgcctgcattttcctgcgcaagggcttcgctgagaacaggcagcctgatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccgggg

SEQ ID NO: 741 - DNA, 1658 bp, Homo sapiens
gggcggggcgcggcggtacctgggccgccagggagccgggggtgggctctccggggacagccggcagcgcccccagatctgcaccgccagccgccgggagctccgggctccgggcgtagaggctgcgctgtcacatgggcggcggcgacggggccgcatttaagcggccgggggacggcgcccgcctccagcgcgtcctcgggcttggctcccgccgggagccccgttctctgcccgccgggggccccgcgccgcgccgcaccgcgccgcccccgccgggccatgcgagcgcgggccccgccgcgatgagctcgcacatcgccaaaagcgagtccaagacgtcgctgctgaaggcggcggcggcggcggcgagcgggggcagccgggctccccgccacggccctgcccgggacccggggctgcctagccgccggctacccggctcctgcccggcgacgccgcagtcgtccggggaccccagttcgcggaggcccctgtgccggccggcgccgcgagaggagggcgcgcgggggagccagcgtgtgctcccccaggcgcactgcaggccccgggaggcgctgccggccgcggcgtcccgaccttcgccgtcgtcgccgctgccgccggcccgcgggcgggatggggaggaacggggactgtccccggcgctcggcctccggggctctctgcgagcccggggccgcggggactccgttccagccgccgcgtccgaggcggacccgttcctccaccggctgcgccccatgctcagctccgcctttggccaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaata

SEQ ID NO: 742 - DNA, 770 bp, Homo sapiens
ccgtcctggaggaagaacggcacagacggagggaggctggggttggcagagactgggacggaagtccctcagtcccccaggagcctccttcatggacccggggatcccaagaggggctgcctcaacttaggatgggcaactgtgtcaagtatccactgagaaatctctcaaggaaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggagg

SEQ ID NO: 743 - DNA, 3259 bp, Homo sapiens
agcgggcggcgagcagcgcggagcgcgcggggcaccgaggagcgggcgcggcgggcaccgcgcgaggcagccggagctctcggaaaggccagagcggcgccgcccccgctgcccctgcggggccccggctgggagcccgacgagggagcgggcggcatggcccggcggcccggggcgcgggggcgctaggcccccggaggggcgtccccagcctcgccgctgccgccgccgccctccgcagccgcgcgccccgcccgctccagccgcccccggggccgccaccggcccatgagccccggcctcaaagtttgcggcgggcgggcgggcgcggagcctccaagatgccgttccacccggtgacggcggcgttgatgtaccggggcatctacaccgtgcccaacctgctgtcggagcagcgcccggtggacatcccggaggacgagctggaggagatccgagaggccttcaaggtgtttgaccgtgacggcaatggcttcatctccaagcaggagctgggcacagccatgcgctcactgggttacatgcccaacgaggtggagctggaggtcatcatccagcggctggacatggatggtgatggtcaagtggactttgaggagtttgtgacccttctgggacccaaactctccacctcagggatcccagagaagttccatggcaccgactttgatactgtcttctggaagtgcgacatgcagaagctgacggtggatgagctgaagcggctgctctacgacaccttctgcgagcacctgtccatgaaggacatagagaacatcatcatgacggaggaggagagccacctgggcacagccgaggagtgtcccgtggatgtggagacctgctccaaccagcagatccgccagacttgcgtgcgcaagagtctcatctgcgccttcgccatcgccttcatcatcagtgtcatgctcattgcggccaaccaggtgctgcgcagtggcatgaagtagacgccacctggatgccccatccaccgcatgcggtgcccgtggcccgccccacaccaccgccgcctgcagacctctcccttggccggctccctgggccgccatctgcgtgtacttcagggcctgggtatccagcgagccctccccacccacccacggtcctcacctggagctgtggcctggctgtggagggccgggtggtggctctgaggatggtccccagccccaccctgtccccaccctggcctgtaaggagcactcactcttcctaccatccaggggctcctgggaaattaaggagggatttgcacaggaacccccaggacccagtcgctgctgtggtcccttgggcaggagcgggcaccctgtgccttgagacagcagcctatctggggccacacagccaacccagccctggtccctgaggtctgcccagggcacagggcacaggcagggacagaaagccttctcctgggggagggtgggaagccagggtgtcctgggccttgctgcctggcatagcctgaggaggcccctggtcttctccttgggccccttcctctgaccctcgttggaccccaacccagacccccttttctccatgtacctgctgggccagcccatttcacaggtgaggaacccgaggctcagggccccgagacttggcctcagttcttccttccacagggattttcaggaaaggcagaagctcgtggaggatgggcatctgaggtggccctgcagccccccaccttctggccctcccaccagaggcccagctaccaaggccacattgtccaccaccccagcctagagcctagaactgtagtccagctgaggaaggaggcagagctggggcctgaaggctctgagcagcctccagccagggggctcctccagggctgaactttgggagggcccctgtactacctcctgggccaagaaactggcacagccccacactgtcagtgccaagaggctgcgccaggccactctctcagcccagggcctgccctcctgtcctcccacttctctacgccctcaaggttggagaccccgctcccatgccccagctgtgccatcccaaatacttgggcagcagctcagcatgggcagacatgggggctgtggattcttccagggcggggatggcagatggagcccttgggctccttgggcctagagccacttcttaccaggcaacgggcacagccaccctggcacaccctctgcctggccgtgctgaacctctgctggtcccaagggagaagggagtgagcgtgggtcacctggggaaaatctcatctgattccctccttgcccgacctctgctaggggctggagaacagagctcagagcacccagtgtagggaaacacagccagaccactgtggtgacagactttctttataaacatttggaagttttctcccccatcttcttaagaagcaggggggcaggtggaggagagtgaggggagagctgcccggtgcagacccaggacgagggctgcacttggtgtggccgtgtcctgagcctcagtgaggctgggcagatggtctcggagcctccatggggcgtagcaggaaccgggcttggcttcctattgtgactgatgagaaaagtgaccacgtgggggtcagtcgggggcaaggggctcagccccactggactctgggctgcagaggccaccccccaggtgggggtgcccgcagggatggaggcagctcctgaactggtggccagcccacggggtactggaagacagtggttctgatgggttcagccctagagagagagagagaagcggggagaataagagtgcactacagcccaggcttatgccacccccagcccacctgcctcaccaccctggctgtggggagggtcagctgcctgcatgacttttctggaaggcagagcctcgaaaataggcagaccgtttgagccagcgacctcacctctaggaactgagcccaaggaaatagcggggttgcaggcagacattgagctgcgagacaatgggaataaccttcgtgtccacctgtgggggactgattcaatacatatgcacgtccacagcagagaatgccatgcggcctgtgtaagaattaaggcagatttatatgcactgatgaggaaagacatactgtgtgatagggagaaaaagcagcttataaaataatgtatatagcatgatactatttttgtttaaaaatatataaaatatataaatgcataaaaaaatcctggaagacacagcaaaatgttaa

SEQ ID NO: 744 - DNA, 3879 bp, Homo sapiens
cggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagcctattggtgtaggtataccaacaattaatttaagaaaaaggagacccaatatccagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatgtaagtactgtgaaagatcagattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggt

SEQ ID NO: 745 - DNA, 3858 bp, Homo sapiens
cggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagcctattggtgtaggtataccaacaattaatttaagaaaaaggagacccaatatccagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggt

SEQ ID NO: 746 - DNA, 7563 bp, Homo sapiens
agggaggaaaccgagagggagagcgagagcgcgcgagcgccggcgggctcgccgaggtctgtttccaaagtcgcccttgatggcggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatcaaaaaagggcaaaatgaaggattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggtgattacatgtgaaagggttccccatacaattgttaatgaaccataagaaatgtcttgatattgacctggaattttgacttgctgcaattttactaagaaaatctctaaggggaaagaaattatttttgccttcactttttcttctgtgaaaagttaattcctgctttaagtagcaattattgaaatatatagagaaagagagaattaacattggtctaaattgttgaaatataaataatggctaattttctatgaaaaatttgccatgaataaaatgccttatgaagaacggcttctttgccaaaaataaaacacaattgatgaccaattcaattttgatggggtaatgaattgatggtttgaaaatagtaactaagaaattattaaactaaaggtgcttgagggagaaattagaatatgtgacatatttcctcataaatgtaagcaagcccttaataaatgctttgatgtaatgttccttttgttcacagtacagttatgtagtgctagccagatatttaaaaatgctctaagaaaagcttgtcaggggggagggggaaatgtttttcttgtgataaatgaactttggtttaccaagggtattttgcatgatgctgctgctattttaacttttcagttgttttttctcttactgtagagtgtagtcattgaaaagttaactgagtgatattgttatgtaagaatctgaaccttgcagtgtaaatgcacttaagtcatctttaaaatgttgttaaactactctgaatatactgtgcaatgtaaatgctgaatgattggggttagataaatggtgaaatgagaattaatgaattttatacagattcatgctttcgcctgataacctatgtacagatattttaagtacataaatcagatttgacacatttattttttgaaaagtacatatatgttctcaatgaagattcatcctaggtttcctctttgttcgtttcaatagtagcacatacaatccaaaagttcctgctactgctgcttttgcccttccattttaaatggtatgatcgtttggccaaaatttccatgcaagttgataagggttttacaataatctgaacaaataggaaaccttgaatctctatgtatgcacatgaatacttgattgtgaataataaaagttgttttttatacagcctcattggtgaaaatggttagtgtagtaaatcagatatttcattatagactaatatggtagcagattatttatgcttttaaaaattattttctggagcaaacagtatttgaagaaaaggtaaaaactatgaatgtgtaattctaagaatagttaataattttactgaaggctgaacgtatgtagatattttttatgataaaatgcagtttttctttttttggaacatgccaattactggtatgtgtatatgctggaaattttcttacatatcctttttaagtcaaagttattaacattatccagcatgctttaatatgctccacatatcaaagatataaccaataatttaacgtagcttaaaagataacatttgttttgtttttagctttgcatacatttgtaattccctcccaccaccaatataccttaggtaccatttgtgtacatttcaagattttttttttcaataaaaaggtggggggaaatggaatcactttgccaactattgttctaagagttgacatcagttaccatttctaatgcattgttgtgattttgtagtgtcattcataactggtattgacattttagaaaacaccaaagtgatttaaaatatatgtggggaaaaaaacttctcactctagtaacaatgttttaatcatgttgtttgttaaatatttaaaagttattgttcaatttttgctagactatcttaaatcatgatagtgttgggaagggggtatcaaaatataaaattgttagtttgtgtatataaacaatgcacattaaaacaattgaattgcttccagcatacaacaaactaccttaaaattatgttcaaaatctattaaatatattttcatggctaatgtcgagtatatgttttcatcaattacattgttattgtattaatcgcggttaaacttggcatctcttggcaggatcctatttaatttctgttgccatcaaaatatatttatatgcatgagttttgctataaacctttattttctgctataaagttatatattatgacaaccataaatgcaattacaaattgggtaagaacaagctgaataaaagttgttcccatgactaatattagtcttcatgcttttagcatattttttaagacagtaacactcatcccatcaaattattacattacatttagtatttttctgagttacattgacaagaacttaaattatagcctgttattaatattgatttccaacgactgaacagtacaacagatcaataaaaaagtttatacactgctttaactaatttttgttatactcatgtggcttagtgtagttagtcactaaaacagagttcaagtgagcttggcaatggtgttgagtaacaagaaagaattttgcattaatgatttctttttattttcctcatttaaacaaccagcattactgccaaacaccaaccgtggtccatatttgtaacaggtttttaacatgacatagttagcaagtttgattgaagagatttttaggtcctgggcctataagattttagtatgatcttttttcatgtttctaatgcttgaggtgttactgcttaacttgggaaaaaaaaaaacaaaaaacagtgttcctgccatttgtaagttttcctataatattccttttattaactttaaaactggacttatcgggttcaaataggcagtatcccttttaagtgacctttgcaacccaagtgttacttgcttatttgatgctctcttgtattttaaatctcatttaaatctttgtctgtgaccaacaaagcttaagattttgtcttcatttaaaactctgaatctattccattgatcatgttagacgttcaaatgtttaatggtatagtctgacctagtgaaacaaaatggatgttgttactttttttaaagaatagaatgaaataactatttcacttgcccaaaattttaaatattttttcatctaaacttgtattgtttcccatagcagaatgtcaatattcacagtacatttctgtaaagagcaaaccaatataatgttttgagtgttgaaaaaaattccagatttttgaagaattagacaactcttcatctaccttatttctagttcacacagttatctcaaattccactgaaactaatgggatactgtcttgtgtagatgccagttgagtttataatgtgacctagtaaagctgtcttttttgttgtgttgtatgagtgtcggatcatgcttttaggaatacttttattaaaatggtgtgcattcatgcaaaaggccaactggcttttgtgaacaatagatcttttctcccctttattttgttctcttgacacttttgtgaaaattacctagcctgataaaaacattttgtaaaaatttgtataatactgttataaaatatttataatcccagaaaatgttgtgttaaatcttgtgcaaaaacagtatattcagaataaaagtttatcatttaaagtca

SEQ ID NO: 747 - DNA, 1447 bp, Homo sapiens
tccttttgtcttacgttttttttctataccaaacaccagccatctctggtagctttcccttatgtatacattcctctctacaagtgataccttcctgctttctgtgtcattgctgtcaattcatactccatgttcaaaatgcacctcagtcattatttcctatgagatgtcttccttaaacatccttcaagtacaaatttaatagatatttaaattattaaaacatagttgtgtatctattgatatatttcctttacttcctaaacttacttctctttgtatcaccaacacctaactttgttttttagaatatgttcaatagaacatttccttgttttgtcttctgtttcagcaagggagtgaaagcacgatttgttgtgactgatggtgggattaccagagtttatcccaaagattgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactccta

SEQ ID NO: 748 - DNA, 3397 bp, Homo sapiens
tatgaggcgcccaccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtgagccgcctgccctttctctccgctccagcctctccccagaacggctctttttgtcacacaggatggcatgtgatcctcaagacgacgaacaatgaactaaagccaaatgcagccctccctggcctccagaggtggcgtgggctggctttgcacgaaggttgtgctgggagaccggacccggggctgcagaagaagctgaaggctgactttgtcccctccccgaaaaagggtgttttgatgcctcagggtctctgaaatctcccgggaagccccagagctttcctgaggctgcctggccttgatcaacttgggaagacaaaattgagccattatctcctcttggaaacgaatcttgccagaaaaacgggatttcagggccttccctccctgcctgggtgtcgggccaccagaaggctctgccggacgccaagaagacggtctctgggctcttgtcagctgcttttgaacctgaggttcctgcgtcgttgagccagaaatcagaccaccgaagctcactcccttcctctccatctctccctctctccaagactctggcagtggcctatgatcctgaagacagctctgcagccaactggtgctttggcctttgcgctgtcccggggccagcttccctcgacctggggaggccgtggcctgtggaggaggcccaggtaaaggctgggggctgttgctggctatcctctttgcttctggaagtttctgcctcactcagaatgggcaggacagacccactgactggacttcagagtctggagggttccatcggtcaggggaatggcggccacgtgacctcttgccgtgccccttgtcatagacccaaggagcaactctgtcccctgagcgttgggggtcccgggggagaggtggacagacacctccctccaactggcatttggcaacaggagcctggacttctgtgcaagaaagggagacctaagggtgaacagtggccaataaaaaccctagagaacaaacatccatttcctaggtggttacaaatcataacttcctgcaaatcaacgccaggagagcaacttaccttcatttctttgtcttaaaaagtagcagcaactggccccacaactcctgtcattgtaagttattctgccaccacctaacaggacggagtggagtgagtttggataaacggaccgagctgggcttctcttcctccctacagaggggagatctcagcactttgtccggagctgaggaagtggtttctgtgttttacagtttttccagccattcttttcttccccctcctgaagcaagcaaagagcgtggaggcgtgtgcaggcttggaagaagaactctccagaacatggaacttaaccctcttttgtataaaacatgtgctttctaaagaaaaattgtttcttattttttgagactccttgatccaccctggaacagtcgcctgtagtcctggtagctgttgtgcttggaaataacgagcgcatccttgcctcagctacctgctcacagcccatgggtggactcggccccctggggttcagacccaggtccgttcggcctagtgatgatgtcatcgtccatcccatcttcctttgcccccaggaaaggacgcatccaccggtagcggccccagctgactgtcgccgtgtgctggggatctgaaatgaggcctgccagggcccctgtgtgctgtgctccagagccttcgctcccatcagggttggcatcatctgatggcatgtccaagtgtgcccagcagcggatgctgaagcaccagagctcaaggccttcacctgctctaggccagccctgtcaccacctccactgccatgaccaggccgaaggcagggaacgccctccccagtcccgctgtccagcaaggccccgagacttttcttctgtgatttccaaaagcaaggcagccgtgctgttctagttcctctccatccgccacctcccctcccgctgccccagaagtttctatcattccatggagaaagctgtgttccaatgaatcctacctcttgcccagtcccaggcagagtaagcagggcccacctagggaccaagaaagagtaggaagaaggggacgagccgggagcaaaaccacctcagacacccgggccttctcagccttctccccgcggccagctgggtctccggggaccctgggccctgggccgcccattcctggccctcccgctgcatctcagacctgacacccaacggggggatgtggtggcctgtgcccaccttctctccctcctcccgacccgccccctcgcccccacccctgtgtgtttcgccagttaagcacctgtgactccagtacctactactggttttgggttggttgttctgtcttttttttaattaaataaaaacatttttaaaatgtt

SEQ ID NO: 749 - DNA, 12870 bp, Homo sapiens
gaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagctttacctttgaactcaagtgcttttctatatgtggttgggggaaagggaacaagttttctttagtttgcacaatgagcaaaggtatcaccagtgtagtcattattctgctctccacaaacaggtttggacattactgttttgcatatcttgtgtttgcttacatttccctcaatttttccaaaatcgtttgctgggtatgtttgtaccgcctcttgctgtgagagaccaggacctattttattccagtcttcactctgtccactctgctctggtcatctgatttggtacttctccaagaacagcccttcactgtgaggtgcagggaggcgttctgatgagccctcagtcactgggccgtcatccgcatcccccatggaagaggtagctggctttcccttcccttccaccacacggaattttctctttggcttccttaggaaagtgtacactaaccgggaggataaaattaaagtcaggctgcttggagggaggggcatcctcacttccggattcttgttgctctacccaacaaggacagcaggggctcgagaaaggaactggtgaaaccctgatccatctgaaagtcaactctgcgtgctcctttctccatcccttcctcactctggagcagcctttccttcaggcttgccctaatgtttgggctgccggggagggggccaggacaagggaagaggcatccggagctcacagtgggggtgggaacagatttttgtgggggcatctctaatgctcacttatatctccctagaacatcactcttttggtgctgtgtccttcaaatgtatgtcaacagtggtggctgaaaagggactgctttggggaaaacaggacccaaccattcacccagaattgacccattaaatctcttccagtcctagtgttccctgagcccctcttggcacatatataagtaagctagaaattacaataagggacagtccattcctctatgacagcttgctggactgattcatgacaaagtggagaaatgtactcaatactccccggttaacacagtctagaaacagagtttctttatggatatccacacccaagtcatccaaactttcttgattccttttcactgccatcaaggtcctctagaaattgagtttaggtatcatcctttgaaaagttcccaagatttctaccaggaggtacacacaggcgttccctgtctagggcaggaggactatcctagcttgaccttctgatccactagaataagactggcgtatgatgcctgtcatcagaacagactggcacaagtagtgacatcaatgaaccacagcacaatcttccaagtgatgtctactctccacctaaaatggaattttccccatgaccttgtaaaacataattgtcacatcttccatacccctcctgacagcccccaagtgtcaggagaaaacagtcaggggctaagggcccaagggacttgaagaaacaacagtttaaggtctgcagtttggtcaacttaattcttgtcctccgaccagccctgcctctttcatttccagaccttggagaatttttcccagctttgattcagaaggtactagttataacccctttccttcttcttaatccaataggcctcactctcactgggaaatccactcaaaggaacaaggcaatgtctctcattctatttcccagttccaaattccaggtgcttgtctggagtgaagctacccgttactttctcccagcttttctccacccagcatgtctcctgcccatgcagctgaagacagtggggcaacctcaggagaagcagacctttccatgcccaagttcatctcctgagcaacagtgacacctagaaaatgaggactttggaagtcacccaaaagatggtggctactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactcccagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaagacaggcggggaagcccaaacctcactcccagggaggccctcagccgccagagtccaggttctccagaggctacgatttgaggaggttgagggggaagacaggagggaaagaaaagtcctacaactgtcaggaatggggcacctttccctgtccctaagcaaagctccctcttcccactgccctccccagccccagctccctgtcctccccaacacctagtgagaaagacggtgcgtggaagggagtcccatgggcagatgcttacacgacctctttgtgaagcctcttctgggtttaacttcattcatcaatttattcttatgtcaaagcaatgaaacttttctttctggagccagataccaatacaacaggtgaacgggtttctgccacatctctacattgacgggggatgcttgaacaacccccctcactacacagacacacaccgttaaggcacaagggctggggttgagctctagatgagggactttcctgctcctgcaagggtgagcactgtatacacagacaaggagggtgcagtagagtgactcccttggatggaagtagtaccatcagaacctactattattatgacataaattctatttacatacattgagagaatactacaatcaacactttttcctgggatgactttaagaggtttgagccacagcacctgaagtggcaaagatccatggtctttgtagggtattagagaactcttccagtcacctctgaaagcactctagatcttgcagctgagtggatgaagtgtaacaaatctgttgcacgctgagaggagtcagaattagcatttttcatgaaagttccccacgtctctactaagaatgaggaagaaaagactaagactaggtaattacacagaggcttgaaatgttacatcaccagagccaagtcctctcccttcagatcagttactggctgctacacagggacacccccaccttttcagggcatcccatgcactccacttctcaggatctaaggaatttgactttgtagggatcccagaaagggcactgtgccacttcccctggtgtgaatcagacatacattgtacattcatttctaaaattcactcatgcacctcaaaccaaggtcattatccaaaaaaaaaaaaaaaaagctctgggtggaagagtttgtaagttttaagagagggtcatttctatgtgaggaaatgcagaaatggacagaatgattcttattcactgtttgggtctggagaattcccattgtggaaatcttagagatctcaagtttattaccaagggaataaggaaaaaaaggtgagcaggcaccaggccaagcagtggctcccttgccaaggaacctgaggctgcaggtttcagggacccccttgaagaaacctctcctggccattggccaggagaaaagagaagtctctcctgtagagtcacaagagaagcaaaagagggtgggtcactgggtcctggacatagcccccaaccccaagacttcccaatatggagaaactacaccaatgtttaaaaggggaaaaggaaagaacttgtacatcaagggaagatgatttgtaaacacacagtcctgtgcagaaagatccccttcaggaggtgtctccagcatcccaaagctgtgcgcaccttctcttttcctgcctcaggccacctatgcatccagctgcagcccatacccacacctgaaatccatctcttgaatcccagccaggttatataccaccccattgccatgtcctgtcctggccagaatgcatgctgttcccccaagcctcgtgggagtgaggccatgggaaacagagatgagcatgtctggacaagtctgtgatggtagtggatgagaataacccatggcaaaacacgcacattcattaagaaatagggcgacagattccccgttggtgaagcactgaaaggtctattactctcataatattgctgttttattttaatccaccagagctaccatgcaaaactttcctcctgtgaaacgctccagataaagctcctctaatctccccttccctcatgtcctccagctcaaacccaccttcatcccccaaaccaatctgtatcatgcctgttatcagagaggcacagaaagatgggcagtgcctccgttgtcaccattccccacacccctacacacccccacaccctcccctccaggctccacgacttcacagtcttactgttgtaaatatcattgtacagtttgtaatcctcaaataatcccattgtcagaggcctcgcctgatgggccttctcaccctcgagaaaggccagggaatctagaaggggcaacccttcaaggagagcttcagggtcatctctgtgtgagacactattgtatattcctgtaagattgcatttttatctaaggaatgatgttatttaaaaaacaaacaaaaaacacaaaaaataagaattgcaaataaatttcttaacaatgtct

SEQ ID NO: 750 - DNA, 6616 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacagggaaaggcacgttccgatgtgtgaggatctggagctcaggagggattcaggctcagcagggactcaggctcactgccttctgctcaggaaagcaaacccctctaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 751 - DNA, 6968 bp, Homo sapiens
ggaaggggcccggatgtactgaggatgcgttacagtttcactcgaggaggcagtagtggaaaggagcagtttttggggtttgatgccataatgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacagaggcactccggcgggcatgcttgatcagaagaaagggaagtttgcttggtttagtcactccacagaaacccatgtgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcg

SEQ ID NO: 752 - DNA, 7848 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaa

SEQ ID NO: 753 - DNA, 7834 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacc

SEQ ID NO: 754 - DNA, 7030 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggccca

SEQ ID NO: 755 - DNA, 7648 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggccca

SEQ ID NO: 756 - DNA, 7497 bp, Homo sapiens
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 757 - DNA, 5243 bp, Homo sapiens
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggtgagccccaggctcagaggtggggctgtggtgaaggaggctggagggggcacagggccatgcttagtgatacctgctgactccggtggaggtgggctccacgaagagatcagcccttcacaccctctgctgtctaaccaccagcatgtcgcaaagcccagtccatcccacagtgccccaaaaagtgggcccatggggtctctagccgtccttaaagatgaagaaacagaggctcagagagggtaaggggcttgcccagggccacagagctacatggtggagcaggaagcacacgtggcagtgggggcaggcagccctggatgtgaatcctgtgcaaatcctgaccccaccattgtcagctcaatgacctggagcagctgacttaccagggcctcagtttcattaactggtgaatggagtcataatagaatctcctcggaggtcacaat

SEQ ID NO: 758 - DNA, 7120 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 759 - DNA, 7226 bp, Homo sapiens
atgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 760 - DNA, 6921 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctga

SEQ ID NO: 761 - DNA, 6752 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 762 - DNA, 6768 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 763 - DNA, 6698 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 764 - DNA, 6788 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 765 - DNA, 6633 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 766 - DNA, 6821 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 767 - DNA, 7116 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 768 - DNA, 7014 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 769 - DNA, 6849 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 770 - DNA, 6600 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 771 - DNA, 6912 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 772 - DNA, 6714 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 773 - DNA, 6767 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 774 - DNA, 6731 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacgctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 775 - DNA, 6837 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 776 - DNA, 6879 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 777 - DNA, 6735 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 778 - DNA, 6891 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 779 - DNA, 6795 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 780 - DNA, 6699 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 781 - DNA, 6870 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 782 - DNA, 6960 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 783 - DNA, 6981 bp, Homo sapiens
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 784 - DNA, 1652 bp, Homo sapiens
gcctgtccctgccttaagtgcctactggatcccgggagcctgggctggggcctgggcactgcttcctccttggcccctcaggcccttggaagcagagagagaacctcttgcagatcccaggctcgtccccagcacagcagacaccaggaaggtggccagagcctcactgagccgaaccgacggccgcccacccacccaggctggagccatggataaattccgcatgctcttccagcacttccagtcaagctcggagtcggtgatgaatggcatctgcctgctgctggctgcggtcaccgtcaagctgtactcctcctttgacttcaactgtccctgcctggtgcactacaatgcactctacggcctgggcctgctgctgacgcccccgctcgccctgtttctctgcggcctcctcgccaaccggcagtctgtggtgatggtcgaggagtggcgccggcccgcagggcaccggaggaaggacccaggcatcatcaggtacatgtgctcctctgtgctgcagagggcgctggccgcccccctggtctggatcctgctggccctccttgacgggaagtgcttcgtgtgtgccttcagcagctctgtggaccctgagaagtttctggactttgccaacatgacccccagccaggtacagctcttcctggccaaggttccctgcaaggaggatgagctggtcagggatagccctgctcggaaggcagtgtctcgctacctgcggtgcctgtcacaggccatcggctggagcgtcaccctgctgctgatcatcgcggccttcctggcccgctgcctgaggccctgcttcgaccagacagtcttcctgcagcgcagatactggagcaactacgtggacctggagcagaagctcttcgacgagacctgctgtgagcatgcgcgggacttcgcgcaccgctgcgtgctgcacttctttgccagcatgcggagtgagctgcaggcgcgggggctgcgccggggcaatgcaggcaggagactcgagctccccgcagtgcctgagcccccagaaggcctggatagtggaagtgggaaggcccacctgcgcgcaatctccagccgggagcaggtggaccgcctcctaagcacgtggtactccagcaagccgccgctggacctggctgcatcccccgggctctgcgggggtggccttagccaccgcgcccctaccttggcactgggcacgaggctgtcacaacacaccgacgtgtagggtcctggccaggcttgaagcggcagtgttcgcaggtgaaatgccgcgctgacaaagttctggagtctttccaggccgtggggaccccacggcaggcaccctaagtcttgttagcctcctttttaaagtagcccaatctctgcctagtttctgggtgtggcctccagcgcgcttcacaaactttaatgtggactcggttcaccgagggccttgttaaatacaggttcagacagtgtagccaggaccgagtctgagattctgcattttaaacaagctcctggaggctgatgtgcttttggtcagtgaaccaaactttgagtagcaagaatctaagtaaatctgccatgggttctgggttctagatgtcaattctaaataataataatgaccttagtctgctgcctcgata

SEQ ID NO: 785 - DNA, 2612 bp, Homo sapiens
acagacctgtaggagctggagtgggagctcaagcaggattcttcccgagtccctgggtaagacaaccctgcttcttttcttggctttagagggtctccttgcttaatgggaagcgtgcagcacctagtgagtggatttgaagagccactttgtaagcaacttgggcatttatttcagccccagttccagtcttccctgactcttttggcatcaaggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtggctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtgccgtggctctgtgcagtgtacgtagatagctctcgcctgggtctgtgctgtttgtcgtgaaaagcttaatgggctggccaggctgtgtcaccttctccaagcaaagccatatggagcatctacccagactcccactctgcacacactcactcccacctctcaagcctccaacctcttggccagattgggctcattaatgtcgttgcctgcccatctgcatgaatgacaggcagctccccatggtggtctgcctgtgagctcttcaagttctaatccttaactccaggattagctcccaagtgcgctgagacccagccagcacacttctggcccttctccctgcctcaatctaaaagcagtgccacaccctccaaagtggaatagaaagaagttcatgagtaagggctgcaaggaattcttatcctggccacatgtcctccgtgcacacacccaatggagttaaccttggaagttgactattttaatgtctgccaggagttctaatcctgcctctgttcccttttctctccttgaaagtccagcacaccattcttgtccttccccagtttcctcgccctccacccctccagcttcatgctcagtgttgtgcttaataaaatggacatatttttctct

SEQ ID NO: 786 - DNA, 2440 bp, Homo sapiens
gagctggagtgggagctcaagcaggattcttcccgagtccctggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtggctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtgccgtggctctgtgcagtgtacgtagatagctctcgcctgggtctgtgctgtttgtcgtgaaaagcttaatgggctggccaggctgtgtcaccttctccaagcaaagccatatggagcatctacccagactcccactctgcacacactcactcccacctctcaagcctccaacctcttggccagattgggctcattaatgtcgttgcctgcccatctgcatgaatgacaggcagctccccatggtggtctgcctgtgagctcttcaagttctaatccttaactccaggattagctcccaagtgcgctgagacccagccagcacacttctggcccttctccctgcctcaatctaaaagcagtgccacaccctccaaagtggaatagaaagaagttcatgagtaagggctgcaaggaattcttatcctggccacatgtcctccgtgcacacacccaatggagttaaccttggaagttgactattttaatgtctgccaggagttctaatcctgcctctgttcccttttctctccttgaaagtccagcacaccattcttgtccttccccagtttcctcgccctccacccctccagcttcatgctcagtgttgtgcttaataaaatggacatatttttctct

SEQ ID NO: 787 - DNA, 920 bp, Homo sapiens
gcatcctccgcatccacatccgcatcgtcgtcctccccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggggcggcggcggcggccaccgaaccccccgggaagccgtcggccaaggcggagaaggaggcggcgcggaaggcggccgggagcgcggcgcccccgcccgcgcagtgacgtctccagccccgcagcccggcccgggcgtcctccgccagctcctgtgaccagcgcgtctcccgatgctctccgccgtgttcgtgtccccaggcgccctcgctgcagccccgcccccgtgggtctctgactctgtcgcttttctctaagtaaagatttcacgtccaccgga

SEQ ID NO: 788 - DNA, 783 bp, Homo sapiens
cccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcagggtaaccacacccaccccacccactgtggggactcaggacaggaggagaaggtggaaggcagctgggggtgcctgggttccgtccaggccagtctggggtccccttgctctcagggaggagagggtggcagtgagtcatcccgcccagagctggccccaccggctgccctgcacccaccaggccccctcccgaggctgcaggtgcagactgaccaaacagtggcgctcctgagatgtttttctttctgggaagtgcccgcgagtgctgcttgcttgtttgcccagtgggtcattgtctcatcttcagtgacttacgggctttctatgtaatacttcctttctgcagtatatctggcaaatatcttctctcatcctcttgtttaaatctgtcaatgttactaatgatagctttagtcatttttagtggactgtttccaaagccttccattctccagtagacagatctgctagggctcccc

SEQ ID NO: 789 - DNA, 533 bp, Homo sapiens
cgaccacagcctcggtctcgcagctgcagcccccgccccgcccggccgcgaagcgtctggaaccgcatcctccgcatccacatccgcatcgtcgtcctccccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggggccctgagttctga

SEQ ID NO: 790 - DNA, 825 bp, Homo sapiens
cccgcccggccgcgaagcgtctggaaccgcatcctccgcatccacatccgcatcgtcgtcctccccgaccgcgtcctgcagcagctgccagtggagccgcctgactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggggccctgagttctgaactggaggctgatcttcggtgtcctgaagccatggctccattacaaactgtccgcagtgtccccaaccgcagaagcgggagggcctgggcccggggcgcacaggagggctcagccccaccgaccctgacccggcccctcccgcagcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggg

SEQ ID NO: 791 - DNA, 3043 bp, Homo sapiens
taatcttgctgcacttattactggacgttgttcataaatatgatttacataaaattcaggacccaatcattgcgcaacaggaggtagcacggtctgcagagagggcgggagctcagaggaggaaaagtcttcggacttgcagggggaattcctcctgggctaacccgggagcggggtccaggccacaaccggccggcggcggcacaggctccatgtgcggctccccctggaggcggttgagcccctcggagcaggagcgcgtagcacacacctcgggccgccaccgcctcccgcccgccaccgcacgcgcacgcgcggttagtagtcgctgctgcgcggccgccggcgggactggtctgaagagacgcggggaccaagtggcaacgacttggacatctgagctgtcactgccgaaaacaggccgcaagagagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctg

SEQ ID NO: 792 - DNA, 2820 bp, Homo sapiens
cgcacgcgcggttagtagtcgctgctgcgcggccgccggcgggactggtctgaagagacgcggggaccaagtggcaacgacttggacatctgagctgtcactgccgaaaacaggccgcaagagagcatctgcccaagcaacaaagaggaggtgtttgcttgggagttaaaagcaaatggcaaccaaagctcaggactgggagagaaaagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctg

SEQ ID NO: 793 - DNA, 706 bp, Homo sapiens
gaagagacgcggggaccaagtggcaacgacttggacatctgagctgtcactgccgaaaacaggccgcaagagagcatctgcccaagcaacaaagaggaggtgtttgcttgggagttaaaagcaaatggcaaccaaagctcaggactgggagagaaaagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtt

SEQ ID NO: 794 - DNA, 2995 bp, Homo sapiens
gatgttgagtctggcgatggggctgcagcgagctagggtcttgactgggctctggcggccccgtgggtggacgcaggaggtggtgccacctgggaccctttgtgtcttcagcaccgccgcatccacctgctgcgcccgggctggggcggacgagcacggggacagctaggtgcctagcccggccggcctcccctgcgggcttgaggagccaccgggagccgaggccgttattccagcggttgccattgcagccccgttccacgcttgagcccggggcgctctcccaatggttgtagagggggcccggggcgcgtctgggcgctgctcactctgctgactgctccttacagaaacccaaacgagatcaaaataggctcggctgtctcagtctccacctatgtggaagcgaagggaccccacttcacggcggtggggccagggactgttggccgctccctcgatacccgcgcagagcccattgtgcgccgccggggggcgggcgaaagggctgggttgaatccagagaggccctaattactagactcattatcgccccaggcctgtttaccatcaatcagacactttcgctgattttatttatagcatctgcccaagcaacaaagaggaggtgtttgcttgggagttaaaagcaaatggcaaccaaagctcaggactgggagagaaaagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaac

SEQ ID NO: 795 - DNA, 1841 bp, Homo sapiens
gctgctgcgcggccgccggcgggactggtctgaagagacgcggggaccaagtggcaacgacttggacatctgagctgtcactgccgaaaacaggccgcaagagagataatcaatatgcatttccaagccttttggctatgtttgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctg

SEQ ID NO: 796 - DNA, 4102 bp, Homo sapiens
gcggcggtagcagcagcgggcccggctggggcgcgagcgcggcgcagcccagcccagcccagtccgagcgcggacccggcgcccgcagccccggcgccgccatggtggaggcggcgccccccgggcccgggccgctgcggaggacctttctagtgcccgagatcaagtcgctggaccagtacgatttctcgcgggccaaggcggcggccagcctggcgtgggtgctgcgggccgcgttcgggggcgcagagcacgtgcccccggagctgtgggagcccttctataccgaccagtacgcgcaggagcatgtgaagcccccggtgacacggctgctgctctcagccgagctctactgcagagcctggcgccaggcactgccacagcttgaaacaccccccaacccctctgcactgctggccctgctggcgcggaggggcacagtgcctgctttgcccgagcgcccggtgcgcgaggccgacctgaggcaccagcccattctcatgggagcccacctagctgtcattgatgccctcatggctgcctttgccttcgagtggacaaagaccctgccaggtcccttggccctgaccagcttggagcacaagctgcttttctgggtggacacgaccgtccggcggctgcaggagaagaccgagcaggaagcggcccagcgagcctctccagcagcccctgcagacggggcggccccggcgcagccctcgatccgataccgcaaggaccgtgtggtggcgcgacgtgccccctgcttcccgacggtgaccagcctccaggacctggccagtggggccgcgctggccgccaccatccactgctattgtccccagctgcttcgacttgaggaggtgtgcttgaaggaccccatgtctgtggcggacagcctgtacaacctccagctcgtgcaggatttctgtgcctctcgccttcctcgtggctgccccctgtcccttgaggacttgctgtacgtcccaccgccactcaaggtcaacttggtggtgatgctggccgagttgttcatgtgttttgaggtgctcaagcccgactttgtgcaagtgaaggacttgcccgatggtcacgctgcctccccccggggcactgaggcctccccacctcagaacaacagcggcagtagttctcctgtcttcaccttccgccacccgcttctgtcatctggtggcccccagtccccactccgaggatccacaggctccctgaagtcttccccgtccatgtcccatatggaggccctgggcaaggcctggaaccggcagctcagccgtcccctctcccaggctgtgtcattcagcaccccctttggcctggacagcgacgtggatgtcgtcatgggagaccctgtgctcctccgctctgtgagctcggacagcctgggccccccgcgtcccgcgccggccaggacccccacccagccacccccggagcctggtgacctgcccaccatcgaggaagctctgcagatcatccacagtgccgagccccggctcctcccagatggggcggccgacggcagcttctacctccactcccctgaggggccctccaagccatccctggcctccccctacctgcccgaggggacctccaaaccactgtccgacaggcccaccaaagcaccagtgtacatgccacaccccgagaccccctcgaaaccatctccctgtctggtgggggaggcatcgaaaccgccagccccatccgaggggtccccgaaggcggtggcttcgtccccagcagccaccaactccgaggtgaaaatgaccagctttgcagaacgcaagaaacagctggtgaaggcagaggctgaggccggagcggggtcccccacgtccactccggccccgccggaggccctgagctcggagatgagtgagctcagcgcccggctggaggagaaacgcagagccatcgaggctcagaagcgacggattgaggccatattcgccaagcaccgccagcggctgggcaaaagcgccttcctgcaggtgcagccgcgggaagcctctggggaggcggaagcagaggcggaggaggccgattccggtccagtccctggtggggagcggcccgcaggcgagggccagggtgagccaacctcacggcccaaggcagtgaccttctcgccagacctgggcccggtgccccacgaggggctgggggaatacaatcgagcggtcagcaagctgagtgccgccttgagctcgctgcagcgggacatgcagaggctcacggaccagcagcagcggctcctggccccgcccgaggcccccggatccgccccaccacctgctgcgtgggtcatccctggccccacgacggggcccaaagctgcatcccccagccccgcccggcgagtcccggccacccggcgcagccctgggcccgggcccagccagtcaccccgcagcccgaaacacacgcggccagcggagctgcggctggcacccttgaccagggtgcttacgccaccccacgacgtagacagcctcccccacctgcgcaagttctcgccgagccaggtgcccgtgcagacgcgctcttccatcctcctggcggaggagacgccccccgaggagccagccgcccggccgggcctcatcgagatcccgctgggcagcctggcagatcccgccgccgaggacgagggagacgggagccccgctggtgctgaggattccttggaggaggaggcgtcttcggagggggagccccgggtggggctggggttcttctacaaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggacttcacgcggcaggagtacgagcgccgggcccagctgaagctgatggacgacctcgataaggtgctgcggccccgggctgcggggtccgggggtccaggtcggggcgggcggagggccacccggcctcgctcgggttgctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaagttg

SEQ ID NO: 797 - DNA, 4183 bp, Homo sapiens
gcggcggtagcagcagcgggcccggctggggcgcgagcgcggcgcagcccagcccagcccagtccgagcgcggacccggcgcccgcagccccggcgccgccatggtggaggcggcgccccccgggcccgggccgctgcggaggacctttctagtgcccgagatcaagtcgctggaccagtacgatttctcgcgggccaaggcggcggccagcctggcgtgggtgctgcgggccgcgttcgggggcgcagagcacgtgcccccggagctgtgggagcccttctataccgaccagtacgcgcaggagcatgtgaagcccccggtgacacggctgctgctctcagccgagctctactgcagagcctggcgccaggcactgccacagcttgaaacaccccccaacccctctgcactgctggccctgctggcgcggaggggcacagtgcctgctttgcccgagcgcccggtgcgcgaggccgacctgaggcaccagcccattctcatgggagcccacctagctgtcattgatgccctcatggctgcctttgccttcgagtggacaaagaccctgccaggtcccttggccctgaccagcttggagcacaagctgcttttctgggtggacacgaccgtccggcggctgcaggagaagaccgagcaggaagcggcccagcgagcctctccagcagcccctgcagacggggcggccccggcgcagccctcgtgccctacgcgctggtactggaagctggttcctcacgcaattgccttctgtttgaaggagtcggggagcaaaccccccatgatccgataccgcaaggaccgtgtggtggcgcgacgtgccccctgcttcccgacggtgaccagcctccaggacctggccagtggggccgcgctggccgccaccatccactgctattgtccccagctgcttcgacttgaggaggtgtgcttgaaggaccccatgtctgtggcggacagcctgtacaacctccagctcgtgcaggatttctgtgcctctcgccttcctcgtggctgccccctgtcccttgaggacttgctgtacgtcccaccgccactcaaggtcaacttggtggtgatgctggccgagttgttcatgtgttttgaggtgctcaagcccgactttgtgcaagtgaaggacttgcccgatggtcacgctgcctccccccggggcactgaggcctccccacctcagaacaacagcggcagtagttctcctgtcttcaccttccgccacccgcttctgtcatctggtggcccccagtccccactccgaggatccacaggctccctgaagtcttccccgtccatgtcccatatggaggccctgggcaaggcctggaaccggcagctcagccgtcccctctcccaggctgtgtcattcagcaccccctttggcctggacagcgacgtggatgtcgtcatgggagaccctgtgctcctccgctctgtgagctcggacagcctgggccccccgcgtcccgcgccggccaggacccccacccagccacccccggagcctggtgacctgcccaccatcgaggaagctctgcagatcatccacagtgccgagccccggctcctcccagatggggcggccgacggcagcttctacctccactcccctgaggggccctccaagccatccctggcctccccctacctgcccgaggggacctccaaaccactgtccgacaggcccaccaaagcaccagtgtacatgccacaccccgagaccccctcgaaaccatctccctgtctggtgggggaggcatcgaaaccgccagccccatccgaggggtccccgaaggcggtggcttcgtccccagcagccaccaactccgaggtgaaaatgaccagctttgcagaacgcaagaaacagctggtgaaggcagaggctgaggccggagcggggtcccccacgtccactccggccccgccggaggccctgagctcggagatgagtgagctcagcgcccggctggaggagaaacgcagagccatcgaggctcagaagcgacggattgaggccatattcgccaagcaccgccagcggctgggcaaaagcgccttcctgcaggtgcagccgcgggaagcctctggggaggcggaagcagaggcggaggaggccgattccggtccagtccctggtggggagcggcccgcaggcgagggccagggtgagccaacctcacggcccaaggcagtgaccttctcgccagacctgggcccggtgccccacgaggggctgggggaatacaatcgagcggtcagcaagctgagtgccgccttgagctcgctgcagcgggacatgcagaggctcacggaccagcagcagcggctcctggccccgcccgaggcccccggatccgccccaccacctgctgcgtgggtcatccctggccccacgacggggcccaaagctgcatcccccagccccgcccggcgagtcccggccacccggcgcagccctgggcccgggcccagccagtcaccccgcagcccgaaacacacgcggccagcggagctgcggctggcacccttgaccagggtgcttacgccaccccacgacgtagacagcctcccccacctgcgcaagttctcgccgagccaggtgcccgtgcagacgcgctcttccatcctcctggcggaggagacgccccccgaggagccagccgcccggccgggcctcatcgagatcccgctgggcagcctggcagatcccgccgccgaggacgagggagacgggagccccgctggtgctgaggattccttggaggaggaggcgtcttcggagggggagccccgggtggggctggggttcttctacaaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggacttcacgcggcaggagtacgagcgccgggcccagctgaagctgatggacgacctcgataaggtgctgcggccccgggctgcggggtccgggggtccaggtcggggcgggcggagggccacccggcctcgctcgggttgctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaagttg

SEQ ID NO: 798 - DNA, 9243 bp, Homo sapiens
gacaaggacagggaggcacgcgcccagatcgcgctccgagtcgacgagggggctcgtgcaggtcccggcgcgcgcgtggggagcggcccgggggcgccgagggagccggcggcagcgaggatgccggcacggggacgcggctgcctgctgggggtgtgagcgagaggctgagcgctgcccgctcggcgcatccattccgcaccgccccctccctgcgggcctcggaggaagccccccgcgctgtgcggaggcgcctcggctgccgggctgcggagccccggcccagcaagagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttga

SEQ ID NO: 799 - DNA, 9459 bp, Homo sapiens
aagagaataaaagctggctccccgagcccgctggggaagctcgctggggtgctatccgcttgagtttgtgtttttttctttcctgcttcttaataaagcttactgcttactctgggtccgcgccacctttaaagctcacggccgcggtctgcgtcttcgttcttgaagtcagcaagaccgcaagcccaccgggaggagcagacgactccggacgcgccatctttaagagctgtaacactcaccgcgaggtccgtggttttattcttaaagtcggcgagaccaacaacccagcagaaggaataaattccgcacacagagtctcagtgccttcgctgacgttcctttgatgagcttctaactctctctgagaacatcgccctggacccccgatgcggctgccagagcaacccggagaggggaagcccgagaatgagaaaaagggggacggaggagccctcggagggggagaggagccgccgaggagccaggcccccgacttccccacctgggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttga

SEQ ID NO: 800 - DNA, 9189 bp, Homo sapiens
tcccccgagatcagcaggagcttactgcttactctgggtccgcgccacctttaaagctcacggccgcggtctgcgtcttcgttcttgaagtcagcaagaccgcaagcccaccgggaggagcagacgactccggacgcgccatctttaagagctgtaacactcaccgcgaggtccgtggttttattcttaaagtcggcgagaccaacaacccagcagaaggaataaattccgcacacagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttga

SEQ ID NO: 801 - DNA, 660 bp, Homo sapiens
atgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtag

SEQ ID NO: 802 - DNA, 786 bp, Homo sapiens
atgcggctgccagagcaacccggagaggggaagcccgagaatgagaaaaagggggacggaggagccctcggagggggagaggagccgccgaggagccaggcccccgacttccccacctgggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtag

SEQ ID NO: 803 - DNA, 777 bp, Homo sapiens
ggtccatcattctgaggagctgcagtgccctgctccttcctgatggcttagagattctccttaactcccagccatggatcttggagaatttcccccgagatcagcaggagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtag

SEQ ID NO: 804 - DNA, 550 bp, Homo sapiens
gtgcctccctggacgtctccaggggcggtcacgcggaatgctggtccccgcagtttcggccattggcccctccacttcggcgccccgccttccccctgggctcaggtgtaatcgtggatctagggtgtgggcacctgggatgaagtagtgaaggcggcgggcgctaggggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcag

SEQ ID NO: 805 - DNA, 1016 bp, Homo sapiens
cacatgtaaactacttgaactccatttcatcttttttcataccatctctaagattgctgccgcatttgcttgttaaactgaaagcatgtttcttgcaaaggctctattggaaggagcagatcgaggtcttggagaagctcttggaggcctctttggaggaggtggtcagagaagagaaggaggaggaagaaatattggagggatagttggaggaattgtgaattttatcagtgaggctgcagcagctcagtatactccagaaccgcctcccactcagcagcatttcaccagtgtggaggcctcagaaagtgaggaagttaggcgatttcggcaacaatttacacagctggctggaccagacatggaggtgggtgccactgatctgatgaatattctcaacaaagtcctttctaagcacaaagatcttaagactgacggttttagtcttgacacctgccggagcattgtgtctgtcatggacagtgacacgactggtaagctgggctttgaagaatttaagtatctgtggaacaacatcaagaaatggcagtgtgtttataagcagtatgacagggaccattctgggtctctgggaagttctcagctgcggggagctctgcaggccgcaggcttccagctaaatgaacaactttaccaaatgattgtccgccggtatgctaatgaagatggagatatggattttaacaatttcatcagctgcttggtccgcctggatgccatgtttcgtgccttcaagtctctggatagagatagagatggcctgattcaagtgtctatcaaagaatggctgcagttgaccatgtattcctgaagtgggaactgagaagtcaagatcctccctggaggacaggactgaaaaccttgccaagctgtacacagttgctgataccctgtgcaacagctctcatttcctggcaagctctttcacaaccctacatatttctgatcatgtgctgccttttactgctgaattaaaacagatatttcacgaaaaa

SEQ ID NO: 806 - DNA, 4882 bp, Homo sapiens
agtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaagtcaataagcacaagccatggatcgagacttcatatcatggagtcataactgagaacaatgacacagtcattttggacccaccactggtagccctggataaagatgcaccggttccttttgcaggggaaatctgtgcgttcaagatccatggccaggagctgccctttgaggctgtggtgctcaacaagacatcaggagagggccggctccgtgccaagagccccattgactgtgagttgcagaaggagtacacattcatcatccaggcctatgactgtggtgctgggccccacgagacagcctggaaaaagtcacacaaggccgtggtccatatacaggtgaaggatgtcaacgagtttgctcccaccttcaaagagccagcctacaaggctgttgtgacggagggcaagatctatgacagcattctgcaggtggaggccattgacgaggactgctccccacagtacagccagatctgcaactatgaaatcgtcaccacagatgtgccttttgccatcgacagaaatggcaacatcaggaacactgagaagctgagctatgacaaacaacaccagtatgagatcctggtgaccgcctacgactgtggacagaagcccgctgctcaggacaccctggtgcaggtggatgtgaagccagtttgcaagcctggctggcaagactggaccaagaggattgagtaccagcctggctccgggagcatgcccctgttccccagcatccacctggagacgtgcgatggagccgtgtcttccctccagatcgtcacagagctgcagactaattacattgggaagggttgtgaccgggagacctactctgagaaatcccttcaaaagttatgtggagcctcctctggcatcattgacctcttgccatcccctagcgctgccaccaactggactgcaggactgctggtggacagcagtgagatgatcttcaagtttgacggcaggcagggtgccaaagtccccgatgggattgtgcccaagaacctgaccgatcagttcaccatcaccatgtggatgaaacacggccccagccctggtgtgagagccgagaaggaaaccatcctctgcaactcagacaaaaccgaaatgaaccggcatcactatgccctgtatgtgcacaactgccgcctcgtctttctcttgcggaaggacttcgaccaggctgacacctttcgccccgcggagttccactggaagctggatcagatttgtgacaaagagtggcactactatgtcatcaatgtggagtttcctgtggtaaccttatacatggatggagcaacatatgaaccatacctggtgaccaacgactggcccattcatccatctcacatagccatgcaactcacagtcggcgcttgttggcaaggaggagaagtcaccaaaccacagtttgctcagttctttcatggaagcctggccagtctcaccatccgccctggcaaaatggaaagccagaaggtgatctcctgcctgcaggcctgcaaggaagggctggacattaattccttggaaagccttggccaaggaataaagtatcacttcaacccctcgcagtccatcctggtgatggaaggtgacgacattgggaacattaaccgtgctctccagaaagtctcctacatcaactccaggcagttcccaacggcgggtgtgcggcgcctcaaagtatcctccaaagtccagtgctttggggaagacgtatgcatcagtatccctgaggtagatgcctatgtgatggtcctccaggccatcgagccccggatcaccctccggggcacagaccacttctggagacctgctgcccagtttgaaagtgccaggggagtgaccctcttccctgatatcaagattgtgagcaccttcgccaaaaccgaagcccccggggacgtgaaaaccacagaccccaaatcagaagtcttagaggaaatgcttcataacttagatttctgtgacattttggtgatcggaggggacttggacccaaggcaggagtgcttggagctcaaccacagtgagctccaccaacgacacctggatgccactaattctactgcaggctactccatctacggtgtgggctccatgagccgctatgagcaggtgctacatcacatccgctaccgcaactggcgtccggcttcccttgaggcccggcgtttccggattaagtgctcagaactcaatgggcgctacactagcaatgagttcaacttggaggtcagcatccttcatgaagaccaagtctcagataaggagcatgtcaatcatctgattgtgcagcctcccttcctccagtctgtccatcatcctgagtcccggagtagcatccagcacagttcagtggtcccaagcattgccacagtggtcatcatcatctccgtgtgcatgcttgtgtttgtcgtggccatgggtgtgtaccgggtccggatcgcccaccagcacttcatccaggagactgaggctgccaaggaatctgagatggactgggacgattctgcgctgactatcacagtcaaccccatggagaaacatgaaggaccagggcatggggaagatgagactgagggagaagaggaggaagaagccgaggaagaaatgagctccagcagtggctctgacgacagcgaagaggaggaggaggaggaagggatgggcagaggcagacatgggcagaatggagccaggcaagcccagctggagtgggatgactccaccctcccctactagtgcccaggggtctgctgcctggcccacatgtcccttttgtaaaccctgacccagtgtatgcccatgtctatcatacctcacctctgatgtctgtgacatgtctgggaaggccttctccagcttcctggagcccaccctttaagccttgggcactccctgtgtttcatccatggggaagttccaagaagcccagcatggccatcagtgaggacttcagggtagactttgtcctgtagcctccacttctgccctaagttccccagcatcctgactacctgtctgcagagtttgcctttgttttttcctgcagggaagaaggcccacctttgtgtcactcacctccccaggctcagagtccccaaggccctggggttccaactcactgtgcgtctcctccacacagaccagtaggttctcctatgctgactccaggttgcttcatacaaggagggtggttgaacttcacacacgtaaggtcttagtgcttaacagtttaaaggaaagtccttgttgaggcagaactaagtttacagggaaaggtacacacattctctctctctctctctctctgtctatctagttccccagcttggagagcctttccccttgcttctttctgaggccatataagcttataagaaaagtcccaaaccaagaataggtccttggccacaagcagggtctgatcccccatcagagctatctgagcctgcctgtctgggcacctgctgcaaccatgcagctaccctgccaggggcactcagcaaacagaaccacagggcccaggaggcattccacacaggcactgccccaggacaacacaacaaggacagtcacaacaaggacaacaaggacacaacacaacacacaacaaggacagtcacaacaagcctagagccagaaagcagatggaaatgctaatgaggtcaaacgtaggcttcatggtgggtggagtgggggtggctgggctcccccaggacagaggggaccctgaggttggcaaggctctcaccactcagccttatggtcccttatctcctatcttccctcttgagaaaatacacgctttctgcatgtattagaaacgcacgagctccaccaagtctacaatgaaagtttgaaatttaactgcaaggaattagaagcatatttgcaatcattgcagcttcttctttcttctgctcataaaaggaggaacactttagatagagggcaaatatatctgaaaacctaatttctttctttttttgataaggaaatcttttccatctccatcctaacatgcacaacctgtgaagagaattgtttctatagtaactggtctgtgatcttttgtggccaagagaatagcaggcaagaattagggccttgacagaatttccacgaagctctgagaacatgtttgtttcgaatgtctgattcctctttgtcatcaatgtgtatgctctgtccccatccttcactcctcctcaagctcacaccaattggtttggcacaggcacagagctggtccctagttaagtggcatttatgttaaaaaaaaatagttcagaatctcagccttttctttgtgtcatcaaaacagcttaagaaggggactactgccaatgtcctctagtctgacctccacccagggaggacccatggcaggtcttttcaactttctgattcatgagaacaaccttgtgaagcttttcccacctcctaaagtgttttctgcatctgttccttcctttggacctcacaacaaatcctgtgaagtaactgagacatctgttgttagatacatttttgtgatgagtaaactgaggcttcgtgattcaa

SEQ ID NO: 807 - DNA, 4185 bp, Homo sapiens
agttcctcggctcccccaaaattgcagccaggggaaggagccttgaaactctccagccccgacgccccagtctcattggctccctcccccgctgcagcacctggtccccccccctcccagtcacctgattggccggcggccccatcaatcgttgcccggctgtgctgacgtcatcctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgtgaggcatcgtcatgtcctggggcaggggcggggggttgggtgtggtgagggaggggacatatcctagggttttcaaataaaacaatcagaaaaaaaaaaaaa

SEQ ID NO: 808 - DNA, 4296 bp, Homo sapiens
gcattgattcctctgctccattcctgcccctctctgccccctccctctgtcctatatatcttcacttctctcctttctccccatcctgtgttctgggagagtggcctcaagttggggcttggctgggagaagtgcagagtgaagggatcaggactgaaatgagttgggaggaggataagcaatcaggatctcaggaaacttctagatctttttctagtttcaattctgcccttaatctatcccttccctttcccagggccttctcacagcccaccactgctccctgaagttccctgtctccattctctagcacgtgaaatcgctaaagaacattctccacttcctgaccatggttcccatggagatagtgatcccctcctcttcacccccagggcaggttgtttccatgggaactgtctaccctgctataggagaaggctatgacctcccgcagaccctctgactcctttagtagctgatttcttgtcctcaaccacccgcctcctgtaaggtgctcctatagggggtggaaaaggtgatggtgctggggtgtgagttgtctgggtcaacaagggttgttgtgggagtagaggccctgctcacaggtgcttcctctcctctccctggggtggggccagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgtgaggcatcgtcatgtcctggggcaggggcggggggttgggtgtggtgagggaggggacatatcctagggttttcaaataaaacaatcag

SEQ ID NO: 809 - DNA, 570 bp, Homo sapiens
aattctctctcgaacctgccatcgtcccgggcttcagaatccactgggcttggttcatcatggtttaaggtgaaattcggggcgaaggaggcaggacaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgg

SEQ ID NO: 810 - DNA, 2913 bp, Homo sapiens
atgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctgggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 811 - DNA, 3314 bp, Homo sapiens
actaatgactggcaagcgatcctatgcagctccaggactcaggctttcccccaactctccactcaccaccccttacattgggcataggaggcctcctccggccccaggctgagggcctaagggagccattgagaaccttggccagggctaagcaggccagtgctcaccagcaccgctgccatcccgcgcgctcctgctctccagtgggattctgcccttaaggctccgccagggtcggggcggggccggttgggaggccccgcccccagcccgcccccggcccggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 812 - DNA, 2905 bp, Homo sapiens
gatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 813 - DNA, 2669 bp, Homo sapiens
agaagacgtgcggagggagacgcagagacagaggagaggccggcagccacccagtctcgggggagcacttagctcccccgccccggctcccaccctgtccggggggctcctgaagccctcagccccaaccccgggctccccatggaagccagctgtgccccaggaggagcaggaggaggtggagtcggctgaatgcccacggtgcgcccggggcccctgagcccatcccgctcctagccgctgccctaaggcccccgcgcgccccgcgccccccacccggggccgcgccgcctccgtccgcccctcccccggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaagatgcagcatc

SEQ ID NO: 814 - DNA, 2405 bp, Homo sapiens
agaagacgtgcggagggagacgcagagacagaggagaggccggcagccacccagtctcgggggagcacttagctcccccgccccggctcccaccctgtccggggggctcctgaagccctcagccccaaccccgggctccccatggaagccagctgtgccccaggaggagcaggaggaggtggagtcggctgaatgcccacggtgcgcccggggcccctgagcccatcccgctcctagccgctgccctaaggcccccgcgcgccccgcgccccccacccggggccgcgccgcctccgtccgcccctcccccggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaagatgcagcatc

SEQ ID NO: 815 - DNA, 2687 bp, Homo sapiens
cagagaggaaagtgacagaagacgtgcggagggagacgcagagacagaggagaggccggcagccacccagtctcgggggagcacttagctcccccgccccggctcccaccctgtccggggggctcctgaagccctcagccccaaccccgggctccccatggaagccagctgtgccccaggaggagcaggaggaggtggagtcggctgaatgcccacggtgcgcccggggcccctgagcccatcccgctcctagccgctgccctaaggcccccgcgcgccccgcgccccccacccggggccgcgccgcctccgtccgcccctcccccggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaagatgcagcatcaa

SEQ ID NO: 816 - DNA, 7412 bp, Homo sapiens
gtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagtaa

SEQ ID NO: 817 - DNA, 1053 bp, Homo sapiens
cggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccaatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattc

SEQ ID NO: 818 - DNA, 1105 bp, Homo sapiens
ggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataaaaattttgcaagctaa

SEQ ID NO: 819 - DNA, 2360 bp, Homo sapiens
gtccctcaaagtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtgggtaagacagcatgtggcaagttgggcagggtcttgttttatttccctagagctgggtttctcagtcttccaaaaggaatcttctgtgaaagtccaatgtttaaaaagtggtaaaagtggagcttctccctttgaagaggcaagtgggggttcccctggggcccctcatccactggactgcggcatcactgggaattctccagagcttgacagagcacagtttgcaaactgctgttctagactgtgttccctgatccattctgacatctaatttttgagttctgataagggagagggaagcagatgagggaaagagtctgtcgctttctgtgacgttttaagagaactgctgtgtttctgcctccactgagtggaattgtatgagtaatgtaatgcaatgtatatagtaagggcttgtaaagtgaaattaaataaacagcaaggtcagggccgggcgtggtggctcacgcctgtaaccccagcactttgggaggccgaggcgggcagatcacgaggtcaggagattgagactatcctggctaacactgtgaaaccccatcgccactaaaaaatacaaaaaaattagccgggcgtggtggcaggtacctgtagtcccagctactggggaggctgaggcaggagaatattgtgaacctgggaggcggagtttgcagtgagccgagatcgcaccactgcactccagcctagacgacagagcgagactccatc

SEQ ID NO: 820 - DNA, 7133 bp, Homo sapiens
acagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagt

SEQ ID NO: 821 - DNA, 3962 bp, Homo sapiens
ccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgt

SEQ ID NO: 822 - DNA, 3764 bp, Homo sapiens
gcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaaatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttg

SEQ ID NO: 823 - DNA, 3673 bp, Homo sapiens
gcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaaatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttg

SEQ ID NO: 824 - DNA, 1704 bp, Homo sapiens
ctggggccgtgtccgccgggcaactccagccgaggcctgggcttctgcctgcaggtgtctgcggcgaggcccctagggtacagcccgatttggccccatggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagta

SEQ ID NO: 825 - DNA, 353 bp, Homo sapiens
caagatgatgaagaacgagagcttcaaatggatcctgcagactatggaaagcaacatttcaatgatgtcctttaagtcctaaaggaatgcttcagaaaacctaaaagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaa

SEQ ID NO: 826 - DNA, 1760 bp, Homo sapiens
ctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaaggtgagcgtgggcctggcctccatgctataaccatgaaacccacctctaagttttttggttgaatttgtgtagaatttcccccacttattagtggcagtgtaacctaaattttttgttttttctttgcaggagaatcgcttgaacccgggaggcggaggttgcaatgagccgaattcgtgccactgcactccagcctgggcaacagagcaagacttcgtctaaaaaaaaaaaaaaaaaatcccaaaaa

SEQ ID NO: 827 - DNA, 1209 bp, Homo sapiens
ctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagt

SEQ ID NO: 828 - DNA, 674 bp, Homo sapiens
gctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacag

SEQ ID NO: 829 - DNA, 3349 bp, Homo sapiens
ctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggc

SEQ ID NO: 830 - DNA, 2091 bp, Homo sapiens
agtctccccagtctccactttggtccccagcgctgtctgcccgaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgcttaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatca

SEQ ID NO: 831 - DNA, 2302 bp, Homo sapiens
aaacccggggagggggcagccgcgactgaggggcctgacgcgggaggagaagaatggggggctgggcctgggggaggtggcaggcgctgggcgcacacaccggggccctctatgggtaacgggggtccctatggttgcccaagatccagttgcgcggaggccacccggggccctggaagctcctaggggcttggaccctggagcctgccgggcaccctctccagctgacctctgcctccaggatttgcctgaaggctgcccccaactctgcacccgccccccgagggccaccgaggaccatgactaagacagatcctgccccgatggccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacaccccc

SEQ ID NO: 832 - DNA, 5709 bp, Homo sapiens
atatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccagtcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatggtctcattatttctttttgtggcagcaaaattctaacatctttccagaagaaatctatgattcctgctttgcttgctacagctcatttgggggcatgaatgttctccttactaacctctcatggagtcatgtgataacagccattgtcatgtgtatggatgccaccattcttgaatttctgctagaaataagtaggttgctattgcacttagagtcatctttgcaagggactcattccaaaccaattccaatcgacctgaaagtcccttgcactaaagaaatgtgatttttttttaacccaaggagaaagttggttgtaacaatttttcaccagaattagcaatctgatagaataggcttttttaacaggaattttaaactggcggtgccagttgcagtgaaggtgaagtggctattgctttatattcgacaaatatttattgagcatctactatatactaggccctgaagatagagcgttgaacaaacccaatagtcttggccctcaaaaagctttatgtgacatagagcatccagctcgacaattagcaaacccctgatattattcatggacttgacatgaggtttggactattcatgagcaacagcagaaggtccatgacccctacaaatttacatttttctatggcccatatttgaaaacctcacattcggagcaggccactttatattcgtgagtgatcccaagctcactgaccaacagaaaagatgctaaaaaaatgtgtcctatcatgtgcctgctccaactgatgggtaatgtctgcctttaagccccagaatggattctccaggcacagtgtggaagagtgctgtggttgattagcaatgtctgccttgggtgaggaaaggggaacactcctcaagtgcctcctactgtcatctccattcagcctagcaccacatccccatgtagaagtgttgtcttctactgcttgccacgtacaagtgtgaaatgccaaggtgagactcgtacacttggggatttgcaatggtttttacccctcatgaaggtcagaggtggactatttgtacacatacacacatgcacaccctctcacgtcctccagaggctgaaagactatcagcatcttggtaactgccatgcatgagcagcaaggacagccttccataatccatgccccatttcctctggaagcctggaaacttttcatttcctgttccttgctaattaacatctaaacatgcttctcatttccagccattgctgatgcttctcagttgaagtttgagccacatccctcttacagctagtgaatgagttggtagcagctactgtatataataataataatagttttaataataggggagggtgggatggggtgtgggtaagttttgccttttgttttgtttttgatgccgtatatagtgaaggggtgaggatattctaaacaaacaaaaattgaataatttattcacagaaactattaagattgtattgtaaagctcacagcaagctcagtgggcagcagctgcaacatctcaccggggaaattattttatttaacgtgagtgagatgtgggccggagaaggtagctgaagctatttataaaacgttgtgtaccttcttccgagctctctcccctttgtgaagggcgcagcaactatacccttgatggatggagatttacgcaatgtgttttactgggtagagtgacagaccttggctgtccctggaattgagaatctggaccttatttccaggcagagaacactgtcctcagaaatgggacttctgataatgaaacaggttgtccaacattttctaatacgcattctacagaacacaggttccaggaggcatcaggttggtgtgatgcagactaagggttttgtggtcaaatatccttaagaaacaaagttaagtcagtttcctttctgcaaggacttttcagccttcaatgtgtgctgtgcatggtgaatccccaaaaataatccttgagtctgtagcatttcctgaacttacatgaccaggatactctattttgcagatcaccccacagagctagggttccaccgagtatactttgcttaggttgacttagcatatctgaggtcttcaaggataaaaactgccaccccaacacccttccattaaaaaaaaaatacaaaatagcaccacagtctccatctggtttatagcaacagaggtactttatttaatgaagcaatggttctaatcctggatactgccacggactacaattctatccctcccagagggagtggaggaagtcttgggtggtgtggacagaaggaagagaggagagggtgagtggggtatagggcccagggtggctccctactcctcaggctcaaaaggatgctcagtgggaacagatgatctcttgatgagtgcttcttcagtttcatagtttggaatcgttcactgtgtgctttttggggggttttcaatggaaattcacgttgctttgcatttctgtgtccgtctttggtcagttgtgcaagcctgctcactgtcatgtgaagatggcctttcatctggcttctctctcttaagtgagaaagattgtccttcaggggacatgacatcaataggtttctggaatgagggactctttctccccgtgttttgctttgtgttcacattttcttttctaatggcattgaaactttaaaaaaaatggattcaactgtttttgcagaatgtagaaagtattctgtgtccttggttaaagaaatccacttgtgaagtgtgcctggaaaatgaaagtttgtgttttttaaagaggaatatttgaaactgctttctatgcatgcttagctggagaaaagtacaggcaggcgtcccatctcccagccacttctcaaaggtgctgctgtgttttaaagaccaggtacagccagggcagtatttgcaaggacattcctgcttactttatccctttggttggaaagctctagatgattcccgcagctcctccagaccccgcctccctgccctccccagctggtctgggaagaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggcagaagaagcagaggcactctgcttgctttcctagccagtcctcccctacacacacacacacacacacacacacacacacacacaatctcagctgcgccattctgtgcaatcccagtgaccaaatcccttccttgcccacctctatgtcagcaggactgaccacatcactcccccgagttcccaccaccagcatttcctccaacctttttccatcacaaccagttagaaccctacaggcaacaaggccttctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttcttttttcacatatttgtatgcagtagagagcctgttgtagaaaacgctccctgtatcttgctgtactgttaaagaaagctgaattccacattgccaacaaaagcgtgaaaatgttcatgaaccttcctccaggaaaagccattcaagcctgattatttttctaagtaacttcaattaaattgaagaaaaaagaa

SEQ ID NO: 833 - DNA, 5696 bp, Homo sapiens
atatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaatcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatggtctcattatttctttttgtggcagcaaaattctaacatctttccagaagaaatctatgattcctgctttgcttgctacagctcatttgggggcatgaatgttctccttactaacctctcatggagtcatgtgataacagccattgtcatgtgtatggatgccaccattcttgaatttctgctagaaataagtaggttgctattgcacttagagtcatctttgcaagggactcattccaaaccaattccaatcgacctgaaagtcccttgcactaaagaaatgtgatttttttttaacccaaggagaaagttggttgtaacaatttttcaccagaattagcaatctgatagaataggcttttttaacaggaattttaaactggcggtgccagttgcagtgaaggtgaagtggctattgctttatattcgacaaatatttattgagcatctactatatactaggccctgaagatagagcgttgaacaaacccaatagtcttggccctcaaaaagctttatgtgacatagagcatccagctcgacaattagcaaacccctgatattattcatggacttgacatgaggtttggactattcatgagcaacagcagaaggtccatgacccctacaaatttacatttttctatggcccatatttgaaaacctcacattcggagcaggccactttatattcgtgagtgatcccaagctcactgaccaacagaaaagatgctaaaaaaatgtgtcctatcatgtgcctgctccaactgatgggtaatgtctgcctttaagccccagaatggattctccaggcacagtgtggaagagtgctgtggttgattagcaatgtctgccttgggtgaggaaaggggaacactcctcaagtgcctcctactgtcatctccattcagcctagcaccacatccccatgtagaagtgttgtcttctactgcttgccacgtacaagtgtgaaatgccaaggtgagactcgtacacttggggatttgcaatggtttttacccctcatgaaggtcagaggtggactatttgtacacatacacacatgcacaccctctcacgtcctccagaggctgaaagactatcagcatcttggtaactgccatgcatgagcagcaaggacagccttccataatccatgccccatttcctctggaagcctggaaacttttcatttcctgttccttgctaattaacatctaaacatgcttctcatttccagccattgctgatgcttctcagttgaagtttgagccacatccctcttacagctagtgaatgagttggtagcagctactgtatataataataataatagttttaataataggggagggtgggatggggtgtgggtaagttttgccttttgttttgtttttgatgccgtatatagtgaaggggtgaggatattctaaacaaacaaaaattgaataatttattcacagaaactattaagattgtattgtaaagctcacagcaagctcagtgggcagcagctgcaacatctcaccggggaaattattttatttaacgtgagtgagatgtgggccggagaaggtagctgaagctatttataaaacgttgtgtaccttcttccgagctctctcccctttgtgaagggcgcagcaactatacccttgatggatggagatttacgcaatgtgttttactgggtagagtgacagaccttggctgtccctggaattgagaatctggaccttatttccaggcagagaacactgtcctcagaaatgggacttctgataatgaaacaggttgtccaacattttctaatacgcattctacagaacacaggttccaggaggcatcaggttggtgtgatgcagactaagggttttgtggtcaaatatccttaagaaacaaagttaagtcagtttcctttctgcaaggacttttcagccttcaatgtgtgctgtgcatggtgaatccccaaaaataatccttgagtctgtagcatttcctgaacttacatgaccaggatactctattttgcagatcaccccacagagctagggttccaccgagtatactttgcttaggttgacttagcatatctgaggtcttcaaggataaaaactgccaccccaacacccttccattaaaaaaaaaatacaaaatagcaccacagtctccatctggtttatagcaacagaggtactttatttaatgaagcaatggttctaatcctggatactgccacggactacaattctatccctcccagagggagtggaggaagtcttgggtggtgtggacagaaggaagagaggagagggtgagtggggtatagggcccagggtggctccctactcctcaggctcaaaaggatgctcagtgggaacagatgatctcttgatgagtgcttcttcagtttcatagtttggaatcgttcactgtgtgctttttggggggttttcaatggaaattcacgttgctttgcatttctgtgtccgtctttggtcagttgtgcaagcctgctcactgtcatgtgaagatggcctttcatctggcttctctctcttaagtgagaaagattgtccttcaggggacatgacatcaataggtttctggaatgagggactctttctccccgtgttttgctttgtgttcacattttcttttctaatggcattgaaactttaaaaaaaatggattcaactgtttttgcagaatgtagaaagtattctgtgtccttggttaaagaaatccacttgtgaagtgtgcctggaaaatgaaagtttgtgttttttaaagaggaatatttgaaactgctttctatgcatgcttagctggagaaaagtacaggcaggcgtcccatctcccagccacttctcaaaggtgctgctgtgttttaaagaccaggtacagccagggcagtatttgcaaggacattcctgcttactttatccctttggttggaaagctctagatgattcccgcagctcctccagaccccgcctccctgccctccccagctggtctgggaagaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggcagaagaagcagaggcactctgcttgctttcctagccagtcctcccctacacacacacacacacacacacacacacacacacacaatctcagctgcgccattctgtgcaatcccagtgaccaaatcccttccttgcccacctctatgtcagcaggactgaccacatcactcccccgagttcccaccaccagcatttcctccaacctttttccatcacaaccagttagaaccctacaggcaacaaggccttctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttcttttttcacatatttgtatgcagtagagagcctgttgtagaaaacgctccctgtatcttgctgtactgttaaagaaagctgaattccacattgccaacaaaagcgtgaaaatgttcatgaaccttcctccaggaaaagccattcaagcctgattatttttctaagtaacttcaattaaattgaagaaaaaagaa

SEQ ID NO: 834 - DNA, 2103 bp, Homo sapiens
gggctgcctctggggggtccgctagtcgcggggcggcggcggcggctgcgggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccacccgcccgcccgctcgcccgctcgcccgctcctgtggtttttctgagcgtgcgggcgccgggaggggatgctgaggctgatggagctgcctccagggctagggccactcaccggaggagggcggggcctgcacttgaagtcaggccgcacctgtctgtttttggaagggtagccgacaaatccttccagagggaaagttctttgtttaagtgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaaggccgggcgggtgactcaggcaggtaatcccagaactttgggaggcccagacagaaggatcgcttgaggtcaggaatttgagacctggccaacatggtgaaaccctgtctctactaaaaaaaaaaaaaaaaaaaaaaaaaaaa

SEQ ID NO: 835 - DNA, 921 bp, Homo sapiens
ggatccccagctcccgagggcccccgtgtgcctgctgtcacctgaacggggctccccggccccgccgaccgcagccctggagcctgcagacgccagcagcaccggcaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcg

SEQ ID NO: 836 - DNA, 1789 bp, Homo sapiens
gcccccagccgtatccagcggactgtcctccgccgcgcgcccggcacagcatggggaggcgctgctgccggcggcgcgtgctggcggccgcctgtctgggcgccgcgctcctgctcctatgcgccgcgccccgctccctgcgcccggcatttggaaacagagccctgggctccagctggcttggtggggagaagagaagccccctgcagaagctctatgacctggatcaggacccgcgctcgaccctggcgaaggtgcaccggcagcggcgcgacctgctgaacagcgcctgtagccgccactcacgccggcagcgcctgctacagccggaggacctgcggcacgtgctggtggacgacgcgcatggcctgctctactgctacgtgcccaaggtggcctgcaccaactggaagcgcgtgctgctggcgctgagcggccaagcccgcggcgacccgcgcgccatctccgcgcaagaggcgcacgcgcctggccgcctgccctcactggccgacttcagccccgccgagatcaaccggcgcctgcgcgcctacttggccttcctgttcgtgcgggagcccttcgagcgcctggcatcggcttaccgcaacaagctcgcgcgcccctacagcgccgccttccagaggcgctacggtgcacgcatcgttcagcgcctgcggccgcgcgcgctccccgacgcccgggcccgcggccacgacgtgcgcttcgcggagttcctggcctacctgctggacccgcgcacgcggcgtgaggagcccttcaacgagcactgggagcgcgcgcacgcgctctgccacccgtgtcgcctccgctacgacgtcgtgggcaagttcgagacgctggcggaggacgcggccttcgtgctgggcctggcgggcgcatccgacctgagcttccctgggccgccgcggccccggggagccgccgcctcccgcgacctggcagcgcgcctcttccgggacatcagccccttctaccagcggcgcctcttcgacctctacaagatggacttcctgcttttcaactactccgccccctcctacctgcggctgctctagcggtcctggaggtcctgtggccacgcggggcaagtgcctttccgacaagacccccggggaatgcaggtgctgccggccccaggacccctcttcaagagccactgcgtgcactcacctggccgccgggccagcgggcgcagggcacacctggccaggcttgggggcagcccatctcaggtggccctgcacgcgtgtgcctgcctcggcctgtcgcctgaggcctgcttcctccacttgctccagctgacaggcacctctccaggccccgtagatgggcaaggacttgataaccagggttttaggcttttaaaggccattttgggggtcagccctgcccctgaacctgttcatggtgcatcagaacataatgctgacaccggtgtcagtgtggcccgagcctgtgtcctccccacctcgcccaccctggcaaggacagctgcggccaaggacgaaagccctcccttggctggcctcacgatggggccgtcccgggagccaggtgggagctgccttccactgccatcgggtctcctctcctctcccacgcggctggccctacccaggcgccaccttcggtctcagtctggcaagacgctgggtcttcaggctccatgccaacagagcccctggtgcaatgcggtcacaggttttatgggactttggtgagctgggcggtcatggttttgaaataaatgtattttgttactttctga

SEQ ID NO: 837 - DNA, 678 bp, Homo sapiens
atggggaggcgctgctgccggcggcgcgtgctggcggccgcctgtctgggcgccgcgctcctgctcctatgcgccgcgccccgctccctgcgcccggcatttggaaacagagccctgggctccagctggcttggtggggagaagagaagccccctgcagaagctctatgacctggatcaggacccgcgctcgaccctggcgaaggtgcaccggcagcggcgcgacctgctgaacagcgcctgtagccgccactcacgccggcagcgcctgctacagccggaggacctgcggcacgtgctggtggacgacgcgcatggcctgctctactgctacgtgcccaaggtggcctgcaccaactggaagcgcgtgctgctggcgctgagcggccaagcccgcggcgacccgcgcgccatctccgcgcaagaggcgcacgcgcctggccgcctgccctcactggccgacttcagccccgccgagatcaaccggcgcctgcgcgcctacttggccttcctgttcgtgcgggagcccttcgagcgcctggcatcggcttaccgcaacaagctcgcgcgcacgcgctctgccacccgtgtcgcctccgctacgacgtcgtgggcaagttcgagacgctggcggaggacgcggccttcgtgctgggcctggcgggcgcatccgacctga

SEQ ID NO: 838 - DNA, 2106 bp, Homo sapiens
acagttgcctttcagtagtcaacatgccaggatgcctccagtctgggggaaaatgcttcctcatttgcttctcccagcccacctcaagcagtctccccaccccttgagtctcagcagtgttaaagctgttactttcacagcttcctgggagcgagtgctttctcaagcccgtcttgcaaggtcttccacttcagcacaatgctactgcctaaaaaaatgaagctcctgctgtttctggtttcccagatggccatcttggctctattcttccacatgtacagccacaacatcagctccctgtctatgaaggcacagcccgagcgcatgcacgtgctggttctgtcttcctggcgctctggctcttcttttgtggggcagctttttgggcagcacccagatgttttctacctgatggagcccgcctggcacgtgtggatgaccttcaagcagagcaccgcctggatgctgcacatggctgtgcgggatctgatacgggccgtcttcttgtgcgacatgagcgtctttgatgcctacatggaacctggtccccggagacagtccagcctctttcagtgggagaacagccgggccctgtgttctgcacctgcctgtgacatcatcccacaagatgaaatcatcccccgggctcactgcaggctcctgtgcagtcaacagccctttgaggtggtggagaaggcctgccgctcctacagccacgtggtgctcaaggaggtgcgcttcttcaacctgcagtccctctacccgctgctgaaagacccctccctcaacctgcatatcgtgcacctggtccgggacccccgggccgtgttccgttcccgagaacgcacaaagggagatctcatgattgacagtcgcattgtgatggggcagcatgagcaaaaactcaagaaggaggaccaaccctactatgtgatgcaggtcatctgccaaagccagctggagatctacaagaccatccagtccttgcccaaggccctgcaggaacgctacctgcttgtgcgctatgaggacctggctcgagcccctgtggcccagacttcccgaatgtatgaattcgtgggattggaattcttgccccatcttcagacctgggtgcataacatcacccgaggcaagggcatgggtgaccacgctttccacacaaatgccagggatgcccttaatgtctcccaggcttggcgctggtctttgccctatgaaaaggtttctcgacttcagaaagcctgtggcgatgccatgaatttgctgggctaccgccacgtcagatctgaacaagaacagagaaacctgttgctggatcttctgtctacctggactgtccctgagcaaatccactaagagggttgagaaggctttgctgccacctggtgtcagcctcagtcactttctctgaatgcttctgagccttgcctacatctctgagccttaactacatgtctgtgggtatcacactgagtgtgagttgtgtccacacgtgctcaagcagaaggacttttgtgtccatgcttgtgtctagaaaacagactggggaaccttatgtgagcagcacatcccaccagtgaaacagggtattgctcttcttcttttcttgatcttcctgtctgggcagacttcagagactttgtggcctggaggcctattaagcacgacacagtatcagtggaattgatccataaacctccctgtccacatcttgcccaatggggaatggatctttcaccaaagagctcaccagcattttccacagagatgcaaattctgagcccttggagttcccagtggattcaaggaaggaagtgggaacaaggttggatgcctacttatgagcttgaccatcacagctatcggtaatcagaaatatgaaacaaaatctctgcacaaaagagcaagctcttaagttcacagggtgcctgggctgcatttgaatatcacttcccctctgcattttcccatcacatagaagactttgacctgtgaagctgccatctgttaatactaaaattcccaaataaggttctgtttagaatgtccctttttatgcttcttaattattagcagtaaatgttcatttttatgggatcctaa

SEQ ID NO: 839 - DNA, 2174 bp, Homo sapiens
gttaaagctgttactttcacagcttcctgggagcgagtgctttctcaagcccgtcttgcaaggtgggtccttttttgtttttggcagaagggagggacagtgaaatgtgctctgagtagggacggttatgcaaaagcaagtaggaggaggaagccaagaggggagttggtgagtcagaggagaaaagcgcatggcccggctagcagtgagcctctcaaaagcagcagggaagcccaagccacaaggtcttccacttcagcacaatgctactgcctaaaaaaatgaagctcctgctgtttctggtttcccagatggccatcttggctctattcttccacatgtacagccacaacatcagctccctgtctatgaaggcacagcccgagcgcatgcacgtgctggttctgtcttcctggcgctctggctcttcttttgtggggcagctttttgggcagcacccagatgttttctacctgatggagcccgcctggcacgtgtggatgaccttcaagcagagcaccgcctggatgctgcacatggctgtgcgggatctgatacgggccgtcttcttgtgcgacatgagcgtctttgatgcctacatggaacctggtccccggagacagtccagcctctttcagtgggagaacagccgggccctgtgttctgcacctgcctgtgacatcatcccacaagatgaaatcatcccccgggctcactgcaggctcctgtgcagtcaacagccctttgaggtggtggagaaggcctgccgctcctacagccacgtggtgctcaaggaggtgcgcttcttcaacctgcagtccctctacccgctgctgaaagacccctccctcaacctgcatatcgtgcacctggtccgggacccccgggccgtgttccgttcccgagaacgcacaaagggagatctcatgattgacagtcgcattgtgatggggcagcatgagcaaaaactcaagaaggaggaccaaccctactatgtgatgcaggtcatctgccaaagccagctggagatctacaagaccatccagtccttgcccaaggccctgcaggaacgctacctgcttgtgcgctatgaggacctggctcgagcccctgtggcccagacttcccgaatgtatgaattcgtgggattggaattcttgccccatcttcagacctgggtgcataacatcacccgaggcaagggcatgggtgaccacgctttccacacaaatgccagggatgcccttaatgtctcccaggcttggcgctggtctttgccctatgaaaaggtttctcgacttcagaaagcctgtggcgatgccatgaatttgctgggctaccgccacgtcagatctgaacaagaacagagaaacctgttgctggatcttctgtctacctggactgtccctgagcaaatccactaagagggttgagaaggctttgctgccacctggtgtcagcctcagtcactttctctgaatgcttctgagccttgcctacatctctgagccttaactacatgtctgtgggtatcacactgagtgtgagttgtgtccacacgtgctcaagcagaaggacttttgtgtccatgcttgtgtctagaaaacagactggggaaccttatgtgagcagcacatcccaccagtgaaacagggtattgctcttcttcttttcttgatcttcctgtctgggcagacttcagagactttgtggcctggaggcctattaagcacgacacagtatcagtggaattgatccataaacctccctgtccacatcttgcccaatggggaatggatctttcaccaaagagctcaccagcattttccacagagatgcaaattctgagcccttggagttcccagtggattcaaggaaggaagtgggaacaaggttggatgcctacttatgagcttgaccatcacagctatcggtaatcagaaatatgaaacaaaatctctgcacaaaagagcaagctcttaagttcacagggtgcctgggctgcatttgaatatcacttcccctctgcattttcccatcacatagaagactttgacctgtgaagctgccatctgttaatactaaaattcccaaataaggttctgtttagaatgtccctttttatgcttcttaattattagcagtaaatgttcatttttatgggatcctaagct

SEQ ID NO: 840 - DNA, 1094 bp, Homo sapiens
aaagtgagaacagacagcagggaacatcaccctcttcagactggagtcagtgggaacagacccaagatgttggggaggaacacttggaagacctcagctttctccttcttggttgagcagatgtgggcccctctctggagtcgttcgatgaggccagggcgatggtgttctcagcgttcctgtgcatggcaaaccagcaataacactttgcacccactctggacggtcccggtctccgtgccagggggcacccggcagtctcctattaacatccagtggagggacagcgtctatgacccccagctgaagccactcagggtctcctatgaagcggcatcctgcctgtacatctggaacactggctacctcttccaggtggaatttgacgatgccaccgaggcatcaggaattagtggtgggcccttggaaaaccactacagactgaagcaatttcacttccactggggagcagtgaacgaggggggctcagagcacacagtggacggccacgcgtaccccgcagagctgcatttagttcactggaattctgtgaaataccaaaattacaaggaagctgtcgtgggagagaatggtttggctgtgataggcgtgtttttaaagctcggggcccatcatcagacgctgcagaggctggtggacatcttgccggaaataaaacataaggacgcgcgggcggccatgcgccccttcgacccctccactctgctgcccacctgctgggattactggacctacgcgggctcgctcaccaccccgccgctgaccgagtcggtcacctggatcatccagaaggagcccgttgaagtggccccaagccagctctctgcatttcgtactctcctgttttctgcacttggtgaagaggagaagatgatggtgaacaactatcgcccacttcaacccttgatgaaccggaaggtctgggcgtccttccaggccactaatgagggcacaaggtcctagagacattaggtccacatgaatagcagaactgactttgaaggaaggaagcgttgtttcccaagtttcacaatgtgattgtacatgacttctgaaattaaaaagagagcatg

SEQ ID NO: 841 - DNA, 3443 bp, Homo sapiens
attactattgtgcggctgcaggaggtgtcgagcggcgttatttttttttgcggtttgcctttttttttcttttttttttttttggaaccgcggttgtttaaaagcctgagggaacctggagaggggctcccactccctaccctctttcctccgagtttgtgactccgagatggacaaagtgtgtgctgtttttggaggctcccgaggcattggcagagctgtggcccagttaatggcccggaaaggctaccgactggcggtcattgccagaaacctggaaggggccaaagccgccgccggtgacctcggcggagatcatttggcatttagctgtgatgttgctaaagaacatgatgttcaaaatacatttgaagagctggagaaacatttaggtcgagtaaatttcttggtaaatgcagctggtattaacagggatggtcttttagtaagaacaaaaactgaagatatggtatctcagcttcatactaacctcttgggttccatgctgacctgtaaagctgccatgaggactatgattcaacaacagggagggtctattgttaatgtaggaagcattgttggcttaaaaggcaactctggccagtccgtttacagtgccagtaaaggaggattagttggattttcacgtgctcttgctaaagaggtagcaagaaagaaaattagagtgaatgtagttgcaccaggatttgtacacacagatatgacgaaagacttgaaagaagaacatttaaagaaaaatattcctcttgggaggtttggagaaactattgaggtggcacatgcggttgtgtttcttttagaatcaccgtatattacagggcatgttctggtagtggatgggggattacaactcattttgtaatttgcagattattcagttataggggtgattagcatcaagggcacactttggctactgattagacaattatacctacatgggtaacatgtgctaatcaaacctgctgatgctacaaatgttaatttctgtctttataaaaatatgtctcaaaagaacaatgtgtgacaaattgtggtttttttttttttggtctaagttacatcagtgttgttttgtttaaaaagccttcatgagatacaattcacataccatataatcacacatttaaaatacacaattcagtggttttaacatatttaaatacatgtgcaatcatccccccagacaaattgtgttttctaaaggatgtgtatcacttacctttggttacctcatagactgtagcaatcttagtgtatagacattttgcaagtcatataaacaagtattgatttatatattttgtctcaaaagtggaaaaattatattgtctaattatgatgaattattttcttgtatcaagctgaattttctaaaagttaaccttgtgggctgttgccaaaataagagtatttagaggacactgattagttgtcaatactttagcaagcccactaaagataactatattccttttgcatgtgcttgggtgatcagtttttatacaggttgcaaaacatagtattcattaaagacatgaatttagaattgatttctttgagtggtatttctcttgattgagcagctagacaaaataatctgcaaatttaaatgtggcgcatttgactcattcttgagaaattctcataagtgaagaggattagcccttaaggttttaatacctggtacagtagtgaaccgcacagatttcatgaacttaggatgtgttttttattcatgaaaaacttagaatagtgaactattaatatttaaaaacgagaaatacaacatttaaaaaattaagagtattttgcattagtgattatgattcttatcccaaaattctagaaagtaataaattctgtatgaataagcataaaaaataaataaatatgcaataacattaaattaaatgtctttacaagaagcagtgaaggcactggtcttaagtgagaatatttgcctgggagtagagataaagacacaaaccgaatgtgaaataccaggtaataattattttgcattaaactctttttatcgggaatagtatgatattttcagtgtcactccattcatgttgatttggagctgacagttattttgtgtaagcagagatttaattttatattgaaagtcagtgcaaaattatgaataggatatactaataaatacaaagtaataacaaaagtcaaagcagtgttctaaataaaaattctgggttccttaaaaattattttaaatttatctttgaaatagttttcttagattaatctcaggatatgagaaagtcaattaagtgtgagtaaagttagtatcattaaacaaattgtctattaaatgcaagacgtggtaatatacagaatttatcaggcattaccaagtctaggcacatataggaaatgcagcactcagaatggtttcaatgtagtagttgatgcttgtaaggtaggggagcttattcagacatagtagatagtttctctaatgctgtctcaattgctggcctttggctacctgtacttccccattatggcagcccattcagtcttgagttttcttctctggacaccttatgctctgaaatcatgagcgaggctgattcaattggtgatttgggtagaaagcagtatgttttgctgacattaagatgtaggttatagataggtttagcctttaagtgtatgtttttatactttaaaataagaaatataaccttttaagctattccacctcctcccccagcctatctcaaactggtggaatatatggagagatcttgaaagaggtaaaataaaccttcactgctccactccaggtgaatccgcccactcccactgacctagtagaatttgtaatttaatacttaccttctatttctgaaatcagttgtgaactgttgccttatgttcagaggtttaagaacctcagtgaattcattttttaaaatctgctattctgagaagcattgaatgaattcttaacaagaagactcatctgtagctgtttgctgactcctatgagcccataagggttctgtgcttagcattaacaaaataaggtttataggtaaagccaatgtattaatttttttttgcatggagggctttaaaatttgtgctctttttcatattttattcatattcaatttatggtttgtaactgctttttagggagataattatatgttataaattagttttggggggaataattgtgcaaagaggataatttaatttacgtgcttctgttattcagaataaagagagaagactacgctgcatattcaagagttgtaccttaacattggtgaaacattttttctaagattttcaaaaggaatatgtgtaaattgagaaatcataaccactgtcctaacttggtaaacaaactgttcttaaataaagtatttaatgattttaaa

SEQ ID NO: 842 - DNA, 1602 bp, Homo sapiens
ctattgtgcggctgcaggaggtgtcgagcggcgttatttttttttgcggtttgcctttttttttcttttttttttttttggaaccgcggttgtttaaaagcctgagggaacctggagaggggctcccactccctaccctctttcctccgagtttgtgactccgagatggacaaagtgtgtgctgtttttggaggctcccgaggcattggcagagctgtggcccagttaatggcccggaaaggctaccgactggcggtcattgccagaaacctggaaggggccaaagccgccgccggtgacctcggcggagatcatttggcatttagctgtgatgttgctaaagaacatgatgttcaaaatacatttgaagagctggagaaacatttaggtcgagtaaatttcttggtaaatgcagctggtattaacagggatggtcttttagtaagaacaaaaactgaagatatggtatctcagcttcatactaacctcttgggttccatgctgacctgtaaagctgccatgaggactatgattcaacaacagggagggtctattgttaatgtaggaagcattgttggcttaaaaggcaactctggccagtccgtttacagtgccagtaaaggaggattagttggattttcacgtgctcttgctaaagaggtagcaagaaagaaaattagagtgaatgtagttgcaccaggttagtgaaaactttattaaaataacttgattatgattattgttttatagggaagccattatttggaacattagtaattgacatctgggtagaatagtttgtaaaatgattgtgaaaagaatcaaataatgaactgggggactcaaaaaaattttttgtacctcatattctatataaagtctatgtgttagcctgtttgcattgctctaaaggactgtctgaggtaattcataaaaaaaagaggcttatttggctctcgggcctgcaggctgtacaagcatgacaccaacatctgctcagcttctggtgaggcccaggaaactttttttcagtcatggcggaaggtaaagaggtagcagccaagtcatatggggatagcaggagcaagagagagaggaggtggcaggctctaaacaaccagctctggcatgaactaacagtgagaactcattatttaccatgtggagggcaccaagctattcatgaggaatccgcctccatgacccaaacacctcccgctaggcccacctccaacattgggaatcacatttcaacatgagatttggaggggacagacatccaaaccataagagtctttatttttaaattttgcactagtggaataacttaaggtggagagggtcttagaaataattttttccagtcatttttgtagattagaaaactgtacctgggattcagagtgacttgcctaaggttacacagctagtttatggaagaactgttactaaaagctttgtcttttgatttccacctaatgggagcttaaaaataatgtcctaccaggtatggtagctcatgtgggaggctgaggcaggagtattgtgaggccaggagttccagatcagcctgagcaacatagcaagatgctgtctgtaccg

SEQ ID NO: 843 - DNA, 3927 bp, Homo sapiens
gtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaaaa

SEQ ID NO: 844 - DNA, 3868 bp, Homo sapiens
gtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatgttaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctg

SEQ ID NO: 845 - DNA, 1982 bp, Homo sapiens
cctctgtctgtgctcccatcccagggagtataggtggagcctccagagcccatggacagggcatgctggggctgggccagccccagcggtgtctctaaggcacccctgggatccccactgagctggcctacttcagacagccagggcccacccctctggcccccttagtgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctgaaaagaataaggagctgcccagtacacacctgcccaccaacgctgggatcctggcggccaccatcattggatctcttgctgccggggcccttctcatcagctgcattgcctatctcctggtgacaaggaactggaggggccagagccacagactgcctgctccgaggggccagggatctctgtccatcttgtgctcggctgtatccccagtgccttcagtgacgcccagcacatggatggcgaccacagagaagccagaattgggccctgctcatgatgctggtgacaacaacatctatgaagtgatgccctctccagtcctcctggtgtcccccatcagtgacacaaggtccataaacccagcccggcccctgcccacacccccacacctgcaggcggagccagagaaccaccagtaccagcaggacctgctaaaccccgaccctgccccctactgccagctggtgccaacttcctgatgggtcctgggccaggccagccagggagaagacaaggccccagccctcctctgggagcctcacacctgagaccagcaggacaaggccattgggggctgtggggccgatgaggtggactcagccaaagactcagcagcacatggggcaggtgtcctggcagggggacaggagactgtaacaggcccaggtccttgtgcagcccgtgaatgcacgcccgccttcggtctgttccttcaagcaagctggcctgggccatgtgcctgtgaaaggcaggctctggcccctttccatgccaaagtcccccaagatctggatatctggggacaagatggtggcctcaggcctgcctcccaggcagttggctgggctcccaactgtctgtcctcaatgccctaccccaactccactagtgaccctcagagtcttctccccttaggacaaggcagacaccccaccatgcgggcctcaggtggcagagaggcccagcctcacaggcctgtggccccacacaccagtcccagcaaggtgaccacggctgctggaccccttccctgttcaggcaggcccagcccctctcagaacctgctgccagctgctggtcttggcccccaccctgaatcttactgagtccctctgggcagcagctcccttctccaccccaccccagcacccgtcccaaatgtggcctcagcttgtcctccccttccccaaactatgcattcattcagcaataaatgagcctttgctgtatgccagacccagttctaggctcttgcagccctggtagaaagcaaaacaaaaactcccgctttcccagagggtcacttggcaggggaaagaatcaggaaataaaataaataatgaacatg

SEQ ID NO: 846 - DNA, 2249 bp, Homo sapiens
gtgaaatcccacctctgtctattggcagacttgcctcttttcctgggcctctgtttccacatctgtgcaatgggaacagttatttatggtggctgctgaatgaggcagtgtgtgtttgaacaaacccaggggaattgttcaaacagaggctgttatgactattgctacagtgactgctgttgtagtcacgctgagtgagaaaaagaggttgaagagggtcaggggaggagtcctgggaagttccccagtcaccctgaaaaactggttcaacctctgtctgtgctcccatcccagggagtataggtggagcctccagagcccatggacagggcatgctggggctgggccagccccagcggtgtctctaaggcacccctgggatccccactgagctggcctacttcagacagccagggcccacccctctggcccccttagtgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctgaaaagaataaggagctgcccagtacacacctgcccaccaacgctgggatcctggcggccaccatcattggatctcttgctgccggggcccttctcatcagctgcattgcctatctcctggtgacaaggaactggaggggccagagccacagactgcctgctccgaggggccagggatctctgtccatcttgtgctcggctgtatccccagtgccttcagtgacgcccagcacatggatggcgaccacagagaagccagaattgggccctgctcatgatgctggtgacaacaacatctatgaagtgatgccctctccagtcctcctggtgtcccccatcagtgacacaaggtccataaacccagcccggcccctgcccacacccccacacctgcaggcggagccagagaaccaccagtaccaggacctgctaaaccccgaccctgccccctactgccagctggtgccaacttcctgatgggtcctgggccaggccagccagggagaagacaaggccccagccctcctctgggagcctcacacctgagaccagcaggacaaggccattgggggctgtggggccgatgaggtggactcagccaaagactcagcagcacatggggcaggtgtcctggcagggggacaggagactgtaacaggcccaggtccttgtgcagcccgtgaatgcacgcccgccttcggtctgttccttcaagcaagctggcctgggccatgtgcctgtgaaaggcaggctctggcccctttccatgccaaagtcccccaagatctggatatctggggacaagatggtggcctcaggcctgcctcccaggcagttggctgggctcccaactgtctgtcctcaatgccctaccccaactccactagtgaccctcagagtcttctccccttaggacaaggcagacaccccaccatgcgggcctcaggtggcagagaggcccagcctcacaggcctgtggccccacacaccagtcccagcaaggtgaccacggctgctggaccccttccctgttcaggcaggcccagcccctctcagaacctgctgccagctgctggtcttggcccccaccctgaatcttactgagtccctctgggcagcagctcccttctccaccccaccccagcacccgtcccaaatgtggcctcagcttgtcctccccttccccaaactatgcattcattcagcaataaatgagcctttgctgtatgccagacccagttctaggctcttgcagccctggtagaaagcaaaacaaaaactcccgctttcccagagggtcacttggcaggggaaagaatcaggaaataaaataaataatgaacatg

SEQ ID NO: 847 - DNA, 1300 bp, Homo sapiens
ctcctctccacagaggaggacagagcaggcagcagagaccatggggcccccctcagcttgtccccacagagaatgcatcccctggcaggggctcttgctcacagcctcacttttaactttctggaacgcacccaccactgcctggctctttattgcatcagcgccctttgaagttgctgaaggggagaatgttcatctctctgtggtttatctgcccgagaatctttacagctatggctggtacaaagggaaaacggtggagcccaaccagctaatcgcagcatatgtaatagacactcacgttaggactccagggcctgcatacagcggtcgagagacaatatcacccagtggagatctgcatttccagaacgtcaccctagaggacacgggatactacaccctacaagtcacatacagaaattctcagattgaacaggcatctcaccatctccgtgtatacgagtcagtggctcagccctccatccaagccagcagcaccacagtcacagagaagggctccgtggtcctgacctgccacacaaataacactggaacctctttccagtggattttcaacaaccagcgtctgcaggtcacgaagaggatgaagctgtcctggtttaaccatatgctcaccatagaccccatcaggcaggaggacgctggggagtatcagtgtgaggtctccaacccagtcagctccaacaggagcgaccccctcaagctgactgtaaaatatgacaacactctaggcatcctgatcggggtcctggttgggagtcttctggtggctgcacttgtgtgtttcctgctcctccgaaaaactggcagggccagcgatcagagtgacttcagggagcagcagcccccagcctccacccccggccatggaccctctgacagctccatctcctaggaattgctacactctgacacaaacatttactgctggatcgaccacaaagcagatgtggcttcttaggttcctctgggagctgctcctgtgggttgatggagcgtccctgaagcccccagccctggggatggggaaggacatggagcctgagccagagaaccagctctgagtcctgaggagacacaggcctggggacaggaagggatgggggtccctgctgaatatatagagacctcaacagactgccccgggctctgggtgggccaaggcgaaggcttcccatcaccacaggaagcgggggcttgcagggaaagtgaatgggcctatggcccacccggggtcacctggaaaggatctgaataaaggggaaacttcctctca

SEQ ID NO: 848 - DNA, 1008 bp, Homo sapiens
ggaggacagagcaggcagcagagaccatggggcccccctcagcttgtccccacagagaatgcatcccctggcaggggctcttgctcacagcctcacttttaactttctggaacgcacccaccactgcctggctctttattgcatcagcgccctttgaagttgctgaaggggagaatgttcatctctctgtggtttatctgcccgagaatctttacagctatggctggtacaaagggaaaacggtggagcccaaccagctaatcgcagcatatgtaatagacactcacgttaggactccagggcctgcatacagcggtcgagagacaatatcacccagtggagatctgcatttccagaacgtcaccctagaggacacgggatactacaccctacaagtcacatacagaaattctcagattgaacaggcatctcaccatctccgtgtatacgagtcagtggctcagccctccatccaagccagcagcaccacagtcacagagaagggctccgtggtcctgacctgccacacaaataacactggaacctctttccagtggattttcaacaaccagcgtctgcaggtcacgaagaggatgaagctgtcctggtttaaccatatgctcaccatagaccccatcaggcaggaggacgctggggagtatcagtgtgaggtctccaacccagtcagctccaacaggagcgaccccctcaagctgactgtaaaatcagatgacaacactctaggcatcctgatcggggtcctggttgggagtcttctggtggctgcacttgtgtgtttcctgctcctccgaaaaactggcagggccagcgatcagagtgacttcagggagcagcagcccccagcctccacccccggccatggaccctctgacagctccatctcctaggaattgctacactctgacacaaacatttactgctggatcgaccacaaagcagatgtggcttcttaggttcctctgggagctgctcctgtgggttgatgga

SEQ ID NO: 849 - DNA, 1098 bp, Homo sapiens
acagtagccctgactacagcattcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtataccaagaaaatgccccaggccttcctgtgggggccgtcgccggcatcgtgaccggggtcctggtcggagtggcgctggtggccgcgctggtgtgtttcctgctccttgccaaaactggaaggccgtggtccctcccacagctctgccttctcgatgtcccctctctccactgcccaggcccccctacccaaccccaggacagcagcttccatctatgaggaattgctaaaacatgacacaaacatttactgccggatggaccacaaagcagaagtggcttcttagcttccgccaggagctgctcctgtgggttgatggagagtccccaaggcccccagccctggggatggggaaggacatgaagcctgagccagagaaccagctataagtcctgagaagacactggtgtctggggacagggagggatgggggtccctgatgaatatctggagacctcgacagcctgccctaggccctgggtgggtcaggacaaaggcctctcatcaccgcagaaagcgggggcttgcagggaaagtgaatgggcctgtggcccacctggggtcacttggaaaggatctgaataaaggggacccttcctctc

SEQ ID NO: 850 - DNA, 1022 bp, Homo sapiens
tcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtataccaagaaaatgccccaggccttcctgtgggggccgtcgccggcatcgtgaccggggtcctggtcggagtggcgctggtggccgcgctggtgtgtttcctgctccttgccaaaactggaaggccgtggtccctcccacagctctgccttctcgatgtcccctctctccactgcccaggcccccctacccaaccccaggacagcagcttccatctatgagaagtggcttcttagcttccgccaggagctgctcctgtgggttgatggagagtccccaaggcccccagccctggggatggggaaggacatgaagcctgagccagagaaccagctataagtcctgagaagacactggtgtctggggacagggagggatgggggtccctgatgaatatctggagacctcgacagcctgccctaggccctgggtgggtcaggacaaaggcctctcatcaccgcagaaagcgggggcttgcagggaaagtgaatgggcctgtggcccacctggggtcacttggaaaggatctgaataaaggggacccttcctc

SEQ ID NO: 851 - DNA, 1316 bp, Homo sapiens
aaatgtagacagaagggagaaaggaagaagagaaaatgaggcaaaactgagaggggaggggacagagaggtgacctgggcagagcttcacccatgaccctggaaagtgctcctgccctgggaggaggctcagcatggaaagaggaaggacagcagagcctaagtcacagtagccctgactacagcattcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtataccaagaaaatgccccaggccttcctgtgggggccgtcgccggcatcgtgaccggggtcctggtcggagtggcgctggtggccgcgctggtgtgtttcctgctccttgccaaaactggaagaaccagcatccagcgtgacctcaaggagcagcagccccaagcccttgcccctggccgtggtccctcccacagctctgccttctcgatgtcccctctctccactgcccaggcccccctacccaaccccaggacagcagcttccatctatgaggaattgctaaaacatgacacaaacatttactgccggatggaccacaaagcagaagtggcttcttagcttccgccaggagctgctcctgtgggttgatggagagtccccaaggcccccagccctggggatggggaaggacatgaagcctgagccagagaaccagctataagtcctgagaagacactggtgtctggggacagggagggatgggggtccctgatgaatatctggagacctcgacagcctgccctaggccctgggtgggtcaggacaaaggcctctcatcaccgcagaaagcgggggcttgcagggaaagtgaatgggcctgtggcccacctggggtcacttggaaaggatctgaataaaggggacccttcctctc

SEQ ID NO: 852 - DNA, 1470 bp, Homo sapiens
agagcctaagtcacagtagccctgactacagcattcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtatacccggagctgcccaagccctccatctccagcaacaactccaaccccaaggaggacaaggatgctgtggccttcacctgtgaacctgagattcacagcacaacctgcctgtagtgggtaaatggtcagagcctcccgaagaaaatgccccaggccttcctgtgggggccgtcgccggcatcgtgaccggggtcctggtcggagtggcgctggtggccgcgctggtgtgtttcctgctccttgccaaaactggaaggtaccacagctttttcccatccttctcccaccccctaggctgactccaggccaaaagaaaggagaccttgtcctgtattcagggccaggctctccacggcctcccaagtccccagggatccttccctcttattccacggctcctccctcgtcagctcctgaccctgggttgctgcctcaacagcttcctcctctgtgaatttggcccaattaaggccccacccctgagtgtggccctagttccctcacacagcaaagccacagctgcctggagggagggagagaaggagggagggaagtagggagggagggagggagggcgtgctctgtacttggtacctcccattgttcattgaatccatccacacagtgagggggatttgcaggctccggatcctgggcaccgtcacacaatggggagtggaccagcctggacaggctgggtggggtcagtgccccccatggctgatgtggtaaccataggccctgaggtgtgagatgggagaacctgggcctcagaacagcatgtcctggagcgtcctttgtgtctcttgccaaggggttgagagagaggacaaggacactgtcctatttcagcatcaccagccctgagtgcagggtctggccacagcagggacactgagttccaggagaatccaagacacttgcggtcccctccgtgtcctgcactaaagcacagagccacg

SEQ ID NO: 853 - DNA, 1205 bp, Homo sapiens
acagaaggaggaaggtcagcagccccgacagccgacagtcacagcagctctgacaagagcgttcctggagcccagctcctctccacagaggacaagcaggcagcagagaccatgggccccccctcagccgctccccgtggagggcacaggccctggcaggggctcctgatcacagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccaaaacaacgtcccaggccttcctgtgggggccgtcgctggcatcgtgactggggtcctggttggggtggctctggtggccgccctggtgtgttttctgcttctctccaggactggaagggccagcatccagcgtgacctcagggagcagccgcccccagcctccacccctggccatggtccctctcacagatccaccttctcggcccctctacccagccccagaacagccactcccatctatgaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctg

SEQ ID NO: 854 - DNA, 2489 bp, Homo sapiens
gaatgagaggggaggggacagaggactcctgagcagagaccccacccctggaccatgtgatcttggaaagtgctcctgccctgggaggaggctcagcacagaggtaggaaggacagcagagctgacagtcacagcagccctgacaagagagttcctggagcccaagctcttctccacagaggacaagcaggcagcagagaccatggggtccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgtttttattatccacctgcagactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactccatttttccctgctcatgcctgcctctttaatttggtaagataatgctgtaactagaatttcacaatcagcgccttgtgcaggtaatttgacagagtgttggatgtgtcatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctactagctgaacagggaggagtttgtgcagttgctgacacttcttgttgcacataaataaatacagtgggtactatagagactcagttgcaaaaattaacaaatatgctgcttgattaaaatgggtaggcttctcatgtggctcattctttaatctattctcttttatttggtttggttcatggggtctctgcctatggatcatacttcaaactcttggtgtgatcctcctgattgtcacaatattagttaccctggtgtgctgtattctctaaaacctttaaatgtttgcatgcagccattcgtcaaatgtcaaatattctctctttggctggaatgacaaaaactcaaataaatgtatgattaggaggacatcataacctatgaatgatggaagtccaaaatgatggtaactgacagtagtgttaatgccttatgtttagtcaaactctcatttaggtgacagcctggtgactccagaatggagccagtcatgctaaatgccatatactcacactgaaacatgaggaagcaggtagatcccagaacagacaaaattttcctaaaaacatgagagtccaggctgtctgagtcagcacagtaagaaagtcctttctgctttaactcttagaaaaaagtaatatgaagtattctgaaattaaccaatcagtttatttaaatcaatttatttatattcttctgttcctggattcccattttacaaaacccactgttctactgttgtattgcccagtaggagctatcactatattttgcagaatggaaactgccctgactcatgaatcacaaataaaagccaattgtatct

SEQ ID NO: 855 - DNA, 957 bp, Homo sapiens
acagaggtaggaaggacagcagagctgacagtcacagcagccctgacaagagagttcctggagcccaagctcttctccacagaggacaagcaggcagcagagaccatggggtccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctatgagtcagtacaagcaagttcacctgacctctcagctgggaccgctgtcagcatcatgattggagtactggctgggatggctctgatatagcagccttggtgtagtttctgcatttcgggaagagtgactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactcca

SEQ ID NO: 856 - DNA, 1236 bp, Homo sapiens
acagaggtaggaaggacagcagagctgacagtcacagcagccctgacaagagagttcctggagcccaagctcttctccacagaggacaagcaggcagcagagaccatggggtccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactcca

SEQ ID NO: 857 - DNA, 1374 bp, Homo sapiens
acagaggtaggaaggacagcagagctgacagtcacagcagccctgacaagagagttcctggagcccaagctcttctccacagaggacaagcaggcagcagagaccatggggtccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaacggtcgagagacaatataccccaatggaaccctgctgatccagaacgtcacccacaatgacgcaggattctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactccatttttccctgctcatgcctgcctctttaatttggtaagataatgctgtaactagaatttcacaatcagcgccttgtgcaggtaatttgacagagtgttggatgtgtcatgtcatcatgtcaaacccaaatatttgacctaagggatcctttattctgcccagtggctaactttaacaacatccctaatacaactgtttatt

SEQ ID NO: 858 - DNA, 2619 bp, Homo sapiens
gaagagtggtgtttttttcttcttcttcttcttttgtggtttcacatagcaaatgagtgacagtctctacttacagacaaagtgagacgtcaggcattgagacatagctccatagaattcagtttctgagaaccagccagaagcatgcagtgacattgcacaatctgcctctgaagctggagatactagctgcagagctcaggggagctgctccacatcaccgacatgaagggaacaggcatcatggactgtgcgcccaaggcactcctggccagggcactttatgacaactgccctgactgctctgacgagctggctttcagcagaggggacatcctgaccattctggagcaacacgtgccagaaagcgagggttggtggaagtgtttgctccatgggaggcaaggcctggcccctgccaaccgcctccaaatcctcacggaggtcgctgcagacaggccgtgccccccattcctgagaggcctggaagaagctcctgccagctcagaggagacctatcaggtgcccactctaccccgccctcccactccaggccccgtttatgagcagatgaggagttgggcggaggggccccagccccctactgcccaagtctatgaattccccgaccctcccaccagtgccagaatcatctgtgaaaagactctcagctttccaaaacaggccatcctcacgcttcccagacctgtccgggcctcactgccgactctgccttcccaggtgtatgacgtgcctacccagcaccggggccccgtggtcctgaaggagccagagaagcagcagttatatgacataccagccagccccaagaaggcaggactccatcccccagacagccaagcaagtgggcagggtgttcccctgatatcagtgactaccttaagaagaggcggttacagcacattaccaaatcctcagaaatcggaatggatttatgacactccagtgtctccaggaaaggccagcgtcagaaacacgcctctcaccagctttgcggaagaatcaaggccccacgctctccccagttccagctccactttctacaatcctccaagtggcagatccaggtccctcactccacaactgaataacaatgtgcccatgcagaaaaaactcagccttccagaaattccttcttatggctttcttgtacccagaggcacatttcctttggatgaagatgtcagctacaaggttccttcaagctttctgattccccgagtggaacagcagaacaccaagcccaatatttatgacatccctaaagcaacgtcgagtgtttctcaggctgggaaggagctggagaaagccaaggaggtgtcagagaattccgcgggccataattcctcatggttctccagacggacaacttccccatctcctgaaccggacagattatcaggttccagttctgacagcagagctagcatcgtttcctcgtgctccaccacatccaccgacgactcctccagctcttcctcggaggagtcagcaaaggagctctccttggacctggatgtggccaaggagacagtgatggctctgcagcacaaggtggtcagctctgtcgctggcctgatgctctttgtcagcaggaagtggagattccgagactatctggaggccaacattgatgcaatccacaggtccactgatcacatagaagaatctgtaagagaatttctggattttgcccgaggagtccatgggactgcctgtaacctcactgacagtaaccttcagaacagaattcgggaccagatgcagaccatctccaactcctaccgcatcctgcttgaaacaaaggaaagcttggataatcgcaattggcctctggaagttcttgtgactgacagtgtccagaacagcccagatgaccttgagaggtttgtcatggtggcacggatgcttccagaagacatcaagaggtttgcctccattgtcattgccaatggaaggctcctttttaagcggaactgtgaaaaggaagagactgtgcagttgaccccaaatgcagaatttaagtgtgaaaaatacatccagcctccccaaagagaaactgaatcacaccaaaagagtaccccttccactaagcaaagggaagatgaacactcttctgaactattaaagaaaaatagggcaaatatctgtggacagaatcctggccctcttatacctcagccttcgagtcaacagactcctgagaggaaaccccgcttatctgaacactgccggctctactttggggcgctcttcaaagccatcagcgcatttcacggcagcctcagcagcagccagcccgcggagatcatcactcagagcaagctggtcatcatggtgggacagaagctggtggacacgctgtgcatggagacccaggagagggacgtgcgcaacgagatcctccgtggcagcagtcacctctgcagcctgctcaaggacgtagcgctggccactaagaatgccgtgctcacgtaccccagccctgccgcgctggggcacctccaggcggaggctgagaagctggagcaacacacgcggcagttcagagggacactgggatgaggactgtctacctcccttcctcctctgctcacc

SEQ ID NO: 859 - DNA, 3155 bp, Homo sapiens
ttcattttactcttatcgtgctttccagaaagtttgcctgctgggagagtctttttgatcgtttcccatgtgttgtcagatagctccatagaattcagtttctgagaaccagccagaagcatgcagtgacattgcacaatctgcctctgaagctggagatactagctgcagagctcaggggagctgctccacatcaccgacatgaagggaacaggcatcatggactgtgcgcccaaggcactcctggccagggcactttatgacaactgccctgactgctctgacgagctggctttcagcagaggggacatcctgaccattctggagcaacacgtgccagaaagcgagggttggtggaagtgtttgctccatgggaggcaaggcctggcccctgccaaccgcctccaaatcctcacggaggtcgctgcagacaggccgtgccccccattcctgagaggcctggaagaagctcctgccagctcagaggagacctatcaggtgcccactctaccccgccctcccactccaggccccgtttatgagcagatgaggagttgggcggaggggccccagccccctactgcccaagtctatgaattccccgaccctcccaccagtgccagaatcatctgtgaaaagactctcagctttccaaaacaggccatcctcacgcttcccagacctgtccgggcctcactgccgactctgccttcccaggtgtatgacgtgcctacccagcaccggggccccgtggtcctgaaggagccagagaagcagcagttatatgacataccagccagccccaagaaggcaggactccatcccccagacagccaagcaagtgggcagggtgttcccctgatatcagtgactaccttaagaagaggcggttacagcacattaccaaatcctcagaaatcggaatggatttatgacactccagtgtctccaggaaaggccagcgtcagaaacacgcctctcaccagctttgcggaagaatcaaggccccacgctctccccagttccagctccactttctacaatcctccaagtggcagatccaggtccctcactccacaactgaataacaatgtgcccatgcagaaaaaactcagccttccagaaattccttcttatggctttcttgtacccagaggcacatttcctttggatgaagatgtcagctacaaggttccttcaagctttctgattccccgagtggaacagcagaacaccaagcccaatatttatgacatccctaaagcaacgtcgagtgtttctcaggctgggaaggagctggagaaagccaaggaggtgtcagagaattccgcgggccataattcctcatggttctccagacggacaacttccccatctcctgaaccggacagattatcaggttccagttctgacagcagagctagcatcgtttcctcgtgctccaccacatccaccgacgactcctccagctcttcctcggaggagtcagcaaaggagctctccttggacctggatgtggccaaggagacagtgatggctctgcagcacaaggtggtcagctctgtcgctggcctgatgctctttgtcagcaggaagtggagattccgagactatctggaggccaacattgatgcaatccacaggtccactgatcacatagaagaatctgtaagagaatttctggattttgcccgaggagtccatgggactgcctgtaacctcactgacagtaaccttcagaacagaattcgggaccagatgcagaccatctccaactcctaccgcatcctgcttgaaacaaaggaaagcttggataatcgcaattggcctctggaagttcttgtgactgacagtgtccagaacagcccagatgaccttgagaggtttgtcatggtggcacggatgcttccagaagacatcaagaggtttgcctccattgtcattgccaatggaaggctcctttttaagcggaactgtgaaaaggaagagactgtgcagttgaccccaaatgcagaatttaagtgtgaaaaatacatccagcctccccaaagagaaactgaatcacaccaaaagagtaccccttccactaagcaaagggaagatgaacactcttctgaactattaaagaaaaatagggcaaatatctgtggacagaatcctggccctcttatacctcagccttcgagtcaacagactcctgagaggaaaccccgcttatctgaacactgccggctctactttggggcgctcttcaaagccatcagcgcatttcacggcagcctcagcagcagccagcccgcggagatcatcactcagagcaagctggtcatcatggtgggacagaagctggtggacacgctgtgcatggagacccaggagagggacgtgcgcaacgagatcctccgtggcagcagtcacctctgcagcctgctcaaggacgtagcgctggccactaagaatgccgtgctcacgtaccccagccctgccgcgctggggcacctccaggcggaggctgagaagctggagcaacacacgcggcagttcagagggacactgggatgaggactgtctacctcccttcctcctctgctcacctctcagcttcacacccacaacttgtgcaactctgccctatgggaaaagccagccggggcatacaccaatgagctgaaacagacctggtgcccaaagctggtagtaccaagtggctaagcaaccccagggcattgacttaccccgcagggggtcaggaaagagagtcaggtatgaggtaaagaccttgtgaagtttagcatatatggagtatgcagtatcagcttgaagtgacttcgcagaaataatattttatattgattaaatgtgtgcatgttttgtttgttttttgagacaaagtctcactctgtcacacaggctggagtgcagtggcgcgatctcagctcactgcaacctccgccttctgggttgaagcaattctcccgcctcagcctccagagtagctggtactacaggtgtgcgccaccatgcccagctaatttttgtatttttttttaatgaaaggtctcacatatttattactgaacccagccaaccaatgcattcataacagattcagaaagaaaaaatatattcccaataaaacatgtacaattctccag

SEQ ID NO: 860 - DNA, 1840 bp, Homo sapiens
attttactcttatcgtgctttccagaaagtttgcctgctgggagagtctttttgatcgtttcccatgtgttgtcagatagctccatagaattcagtttctgagaaccagccagaagcatgcagtgacattgcacaatctgcctctgaagctggagatactagctgcagagctcaggggagctgctccacatcaccgacatgaagggaacaggcatcatggactgtgcgcccaaggcactcctggccagggcactttatgacaactgccctgactgctctgacgagctggctttcagcagaggggacatcctgaccattctggagcaacacgtgccagaaagcgagggttggtggaagtgtttgctccatgggaggcaaggcctggcccctgccaaccgcctccaaatcctcacggaggtcgctgcagacaggccgtgccccccattcctgagaggcctggaagaagctcctgccagctcagaggagacctatcaggtgcccactctaccccgccctcccactccaggccccgtttatgagcagatgaggagttgggcggaggggccccagccccctactgcccaagtctatgaattccccgaccctcccaccagtgccagaatcatctgtgaaaagactctcagctttccaaaacaggccatcctcacgcttcccagacctgtccgggcctcactgccgactctgccttcccaggtgtatgacgtgcctacccagcaccggggccccgtggtcctgaaggagccagagaagcagcagttatatgacataccagccagccccaagaaggcaggactccatcccccagacagccaagcaagtaatcctggccctcttatacctcagccttcgagtcaacagactcctgagaggaaaccccgcttatctgaacactgccggctctactttggggcgctcttcaaagccatcagcgcatttcacggcagcctcagcagcagccagcccgcggagatcatcactcagagcaagctggtcatcatggtgggacagaagctggtggacacgctgtgcatggagacccaggagagggacgtgcgcaacgagatcctccgtggcagcagtcacctctgcagcctgctcaaggacgtagcgctggccactaagaatgccgtgctcacgtaccccagccctgccgcgctggggcacctccaggcggaggctgagaagctggagcaacacacgcggcagttcagagggacactgggatgaggactgtctacctcccttcctcctctgctcacctctcagcttcacacccacaacttgtgcaactctgccctatgggaaaagccagccggggcatacaccaatgagctgaaacagacctggtgcccaaagctggtagtaccaagtggctaagcaaccccagggcattgacttaccccgcagggggtcaggaaagagagtcaggtatgaggtaaagaccttgtgaagtttagcatatatggagtatgcagtatcagcttgaagtgacttcgcagaaataatattttatattgattaaatgtgtgcatgttttgtttgttttttgagacaaagtctcactctgtcacacaggctggagtgcagtggcgcgatctcagctcactgcaacctccgccttctgggttgaagcaattctcccgcctcagcctccagagtagctggtactacaggtgtgcgccaccatgcccagctaatttttgtatttttttttaatgaaaggtctcacatatttattactgaacccagccaaccaatgcattcataacagattcagaaagaaaaaatatattcccaataaaacatgtacaattctcca

SEQ ID NO: 861 - DNA, 2487 bp, Homo sapiens
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 862 - DNA, 1735 bp, Homo sapiens
ctggtggaccagctggctcctaaagaggagaggggactaaatcatgtatgcttggttctttcttcccagcttctctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttcatgatgctgactcttgtga

SEQ ID NO: 863 - DNA, 1799 bp, Homo sapiens
gtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttcatgatgctga

SEQ ID NO: 864 - DNA, 976 bp, Homo sapiens
gcgggcccgcgagtccgagacctgtcccaggagctccagctcacgtgacctgtcactgcctcccgccgcctcctgcccgcgccatgacccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctgctgaccctggagcagccgcagggggattctatgatgacctgcgagcaggcccagctcttggccaacctggcgcggctcatccaggccaagaaggcgctggacctgggcaccttcacgggctactccgccctggccctggccctggcgctgcccgcggacgggcgcgtggtgacctgcgaggtggacgcgcagcccccggagctgggacggcccctgtggaggcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacacacgacc

SEQ ID NO: 865 - DNA, 1200 bp, Homo sapiens
actgcctcccgccgcctcctgcccgcgccatgacccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctgctgaccctggagcagccgcagggggattctatgatgacctgcgagcaggcccagctcttggccaacctggcgcggctcatccaggccaagaaggcgctggacctgggcaccttcacgggctactccgccctggccctggccctggcgctgcccgcggacgggcgcgtggtgacctgcgaggtggacgcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacacacgacctcctgagcctccgtgtgtggcgctggatggggaagggagggaaggcccagcacagacagctcctgccttcagtgaaaggggccttgagattcgtcccctccctggcgccaggtctgtggcccaactgcaggaacctccagctggcaggaggcaggttataaagttttaactggcctggccacgtgtaatggccagagaccccagcacctcgggcttgtctgcctcctacatctctccctcagggcaggcgaagctctggttctgagcagctgggactggtagagagccacgtctggtgtctgacaacatgaaa

SEQ ID NO: 866 - DNA, 2954 bp, Homo sapiens
aggctgggaggagccgaggaaccgaaagagaaaacaggccgcgcgggcggcagaggagccgggcgccgcaatggacgtgcgggcgctgccgtggctgccgtggctgctgtggctgctgtgccggggcggcggcgatgcggactcccgcgcccccttcaccccgacctggccgcggagccgcgagcgtgaagccgccgccttccgggaaagtcttaatagacatcgatacttgaattctttatttcccagtgaaaactccaccgccttctatggaataaatcagttttcctatttgtttcctgaagagtttaaagccatttatttaagaagcaaaccttccaagtttcccagatactcagcagaagtacatatgtccatccccaatgtgtctttgccgttaagatttgactggagggacaagcaggttgtgacacaagtgagaaaccagcagatgtgtggaggatgctgggccttcagcgtggtgggggcagtggaatctgcttatgcaataaaggggaagcccctggaagacctaagtgtccagcaggtcattgactgttcgtataataattatggctgcaatggaggctctactctcaatgctttgaactggttaaacaagatgcaagtaaaactggtgaaagattcagaatatccttttaaagcacaaaatggtctgtgccattacttttctggttcacattctggattttcaatcaaaggttattctgcatatgacttcagtgaccaagaagatgaaatggcaaaagcacttcttacctttggccctttggtagtcatagtagatgcagtgagctggcaagattatctgggaggcattatacagcatcactgctctagtggagaagcaaatcatgcagttctcataactgggtttgataaaacaggaagcactccatattggattgtgcggaattcctggggaagttcttggggagtagatggttatgcccatgtcaaaatgggaagtaatgtttgtggtattgcagattccgtttcttctatatttgtgtgacatgttgggcagatcaagagacagctacaaaaatgaaggttttcataatgcaatgtaacatagtacttcaaagtattattcaacttcaagtttcagcaactacctacaaaagattctaaggcctagtagtatttaaactaagtttcagaatgttcccttcttgtagagagatggacaaccaaagtcagtgggacaaactccagcacagaagcctgcgaggaagcctatggaatagtttcctgtcctgagacgaaattcagattaggagatattttaggcccctgcaactggggaaggctactgtttgtttttgtttgcttattatttatttgtttgtttattgtgagatatttcaggtgggatcaaagaggtcataagaatttattttcttttgtggggtgtaactactagctttagattacccctatacacaagaatggccaacctaaaattatgtgtgtcttgtacagttagttatattagcagccctctgagatggcgtatctatcggaaggatttcaaacaccaattgctttacctgaacaaatggtgcttaccctttgaacagcagagtgaccacgtagaaggaaggaaaagggcaaaatcgcttcagttaaactgaaattaaatgaacaataaggcaactatataagtaacttctagtagcattgcctgagagacaaattattgtttgataattttcattgtgaataggaatccaatagatcatattgcttactttgttctttttatactatagaataatattttgttctctagtatatcaaaataccaaaatattatctcatattttctccctctttctcttactctttaccaagttttcctggtggcttggcttccctgactaaagaattaagtctcatttttactttccatttctattttcttaccacttggttggctccctttgtctctgtacctttaccaacattaggatctcacctctttcttcctcccttaattcataagcaccactcctatcaaagtcccatctcttaaccctgggtatcaaacaaactgtgagttttccagaatctgtttcccagttttcccctcagctttcctggtctcccatccgaactgcttctttgtgcacctcttgttctttctcttggctcccagtcttgattcctgtgatcactcttgcatcactaattgcacaagtgatttcaggtgcaattctgattagcctgcgtccacacagtgatcgatgatcctatgtgcctagaaaggacactgtgtgctgctcatgacctgcaacaggaaaaaagccatttcttgttagcagtgtaagaaccttagagcaaaggagttgaccttctgattgaatataagcacaaccatattaaatgaatcaatacaagaaaattatttctgatactatgtatgtacatatttcttctctaaaatgtatcattcttttctaatgtatatgatctaacaaaaatgaaacatgaaatgcagtagcaaccactaaaaaaaaaaattcaaggacatctaactttttctctcacttttgccctttgtttatccttccctgtgattagataaacaaaataaaaaacaaaatgctgtatttctcttcttacgccagtcagaaccaatccgaaaagaatgtgtgttgactcaggtttggagttatttcaggaagacagatattgaccttttaattgataaatattcttattatcctggaatgccagaaaagaactatgtcctgcttgtctagtttgtattcgctgactttctatgtgatatagatgcatttgtaatactctttttcaagtgctaaaggatttctaaaatttcaaactgattaatatgtttctgctgttctggattttgatgacatttacaataaaacaacctacatttgactttggtttaaaaagaa

SEQ ID NO: 867 - DNA, 1732 bp, Homo sapiens
atggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacagttcaagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggcca

SEQ ID NO: 868 - DNA, 1924 bp, Homo sapiens
gctccgcatggtcctgggctgtgggtaggggctagggccgggtcccggggtgagccgaaacctgggggtcgagcggggcggggaatggggcgcagtgaggctgggagccggccctgagctcgtcttgcataggggtagccaggctcggggcacctgagctggaggcggaagcgtgaaataaggactgagtgggcaaagagaacctgggctgagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacagttcaagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaatt

SEQ ID NO: 869 - DNA, 1918 bp, Homo sapiens
gctccgcatggtcctgggctgtgggtaggggctagggccgggtcccggggtgagccgaaacctgggggtcgagcggggcggggaatggggcgcagtgaggctgggagccggccctgagctcgtcttgcataggggtagccaggctcggggcacctgagctggaggcggaagcgtgaaataaggactgagtgggcaaagagaacctgggctgagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaatt

SEQ ID NO: 870 - DNA, 1706 bp, Homo sapiens
gctccgcatggtcctgggctgtgggtaggggctagggccgggtcccggggtgagccgaaacctgggggtcgagcggggcggggaatggggcgcagtgaggctgggagccggccctgagctcgtcttgcataggggtagccaggctcggggcacctgagctggaggcggaagcgtgaaataaggactgagtgggcaaagagaacctgggctgagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacaggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaatt

SEQ ID NO: 871 - DNA, 3898 bp, Homo sapiens
gttgctccgcatggtcctgggctgtgggggtagccaggctcggggcacctgagctggaggcggaagcgtgaaataaggactgagtgggcaaagagaacctgggctgagcagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggccaggcgtggtgaaaccctgtctctactaaaaatacaaaaaaattagctgggtgtggtggcagatgcttgtaatcatagctacttgggagcctgaggcaggagaatcacttgaacctgggagtcagaggttgcagtgagccaagattgcaccactgcactccagcctgggcaacagagtgagactctgtataagtgtcttataaatactcctgatagctgctcagtagtgtgaccctgagataagggatattgaaaggcataaggtcaagtaaaagagttagttcaagctgagtgtggtgatgtgtgcctctagtcccagctatgggctgaggcaggattgtttgaggcagggagttcgaggctacagcaagctaggatcatatcactgcattccagcctgggcaacatagcgagaccctatctctaaaaaagaacaaaacaagttagctcagatgccagtggagtctgtgctccttagctttctaccctttccacagctcctgaatctgactcatttcttgactttatcattatagcttccacccttcctgcaacctctactgcctgattagagtcctaattttaccctctccctccctgatgcataggtaaaggcccctctgtggagtaaggagatcttcagagctgttagtgtaactaattgagaagtattgtttccattgcgtgttccactcatgttgcttctcttgtgaaccattaactttaattggatattatttttacctgtttctggaccggaagtctctttatttcattttgccatagctcagggcagtgttcaaatcagtaagtgttgtacaggtttttagtgttagaagggatttcagagttaatctatctcccatcaaagcaggaacaccttttagaacatcactgaaaggaggattatccaggtaatgcttaatgtttctagttatttgggatttattatctagaagggatcccattccatcgttagaagacttaagtctttagacatgtttattattaaaaattatatcacttattgagtgtttaacatgtatgaggttatttatatatttagtatatatatactgtatatagagtatgcatatttcataaaataatcatatatggaagatagcgtcacatttttagagatcagaaaactaaggcctaaagaaattaagtaagttaagtagcttgcccaagagcacataccaagtaagaggtagagctaaggttctaactcaggttaaaaattctgagttgagaaaaaaatcagttgaagccatttaaacaataaaatagcttactggagactggaaaattcaaaggtagtatagcttcaggattgatttaatgtaaaaattcactgttgttagatctgtggttttgtttctctggaattttcctgtctgcgctctcctccacgtgttcttgttattctcagactggcttcacttgggtagccagacaattttctgaagcgcctaggcttgcatacctatttccccatatgcaggggaagagagccggtgactcctttctcagtcaatgaacaaaatttttgagctttgggtcacaataatggttattcttggagtgaagatactgatggggaggaagcatgaagcatctggagtgctatagatatgttccatatcttgatctgcatggtggttacaccggtatatacagatgtaaaaattcaacaaaatgtacacttaaaatttgggcattaactgcaggtaagtcaacctccactcctctaaagatatcctgaccaccactctgattggaccaagaagttaggtcatatgcttacgtctgaacaaattgttgaggtaaggtggtggttgtgatgaaatcactaattaaggctttctcctgaactggaggtaaggtcagtaacacccaaccttaagtaagggctgctacccaagtggggaagagatggaagggggcaatagggtggtaattataaagtcctcacctaagagtatgtctggcaaaaaggccaagatggggaaaaggcaaatgaattgaatgtccagaataaacaaatctatgaagaca

SEQ ID NO: 872 - DNA, 568 bp, Homo sapiens
gtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgaggtatctgccggtactgagatgtaagtgatcagctgaagggagaaactgtacaccatgtgacggacaaattgcctgcctcaagaaagcacttaggaccattctgcagccactcagtgaccttggctagaaaccaatggctgtgcggcgtgagcagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctag

SEQ ID NO: 873 - DNA, 275 bp, Homo sapiens
agtgatcagctgaagggagaaactgtacaccatgtgacggacaaattgcctgcctcaagaaagcacttaggaccattctgcagccactcagtgaccttggctagaaaccaatggctgtgcggcgtgagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttg

SEQ ID NO: 874 - DNA, 252 bp, Homo sapiens
ggctgtggcagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgc

SEQ ID NO: 875 - DNA, 1802 bp, Homo sapiens
ttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctccctttttccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtccgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtttttaaaa

SEQ ID NO: 876 - DNA, 1636 bp, Homo sapiens
ggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctccctttttccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtccgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagttttt

SEQ ID NO: 877 - DNA, 2885 bp, Homo sapiens
caacaggctgggcggtggtgtctcacgcctgtaatcggagcactttgggaggccgaagtgggagaccatttgaggccaggagttcgagagcagcctgggcaacacagaccccacctctacaaaaaaataaaactggccttggtggcgcgcgcctgtaatcctagctacttgggaggctgaggcagggggattgcttgagtgtcggacgttgaggctgcagtgagctgagatcgcgccactacactccagcctggatgacaaactgagaccctatcagaaaaaacaacaacaacaaaaaaacagtgcccgctcggtttttcctgaaacgcgcagccctcgcctgtagccaggagaaaactccgcgagccagcaaaacacaaactcggccaggaaacagacaacaaggccacccgggggtgcctgaagaggacgctgcgaggcggattctttttccgggcctgcggcgagtgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaattctggtttggtgttgagtctctctcctgctgcctatttatagattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtgtgtgtgtcctcgtgtctctctactttttcttcttcttgctggtgatggtcttgctggatggggacacggtcacatcctccttgggagggtccagtatgaggtgagaggatgacacgtctgccggctccttgagcactgtgatgtccacctcatagtcatgtctcttggcctcttcctctctcaagataaagatgttcagcct

SEQ ID NO: 878 - DNA, 1636 bp, Homo sapiens
ggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagttttt

SEQ ID NO: 879 - DNA, 3547 bp, Homo sapiens
actcaacctctgaatgttagtgacactattgggacgaaaaaggactgtgctggcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaagcggagacgtctacgtggagagggtccagggcaactcagtcttgttgcacatctcaaaactccagatgaaggatgctggcgagtatgagtgtcacacaccaaacactgatgagaaatactatggaagttacagtgcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccaggtttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcatgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaagtgatgttaaccaacacctttgacctgtcctgtgtcgtgagggccggttactctgacctcaaggtgccactcactgtgacgtggcagttccagccagctagctctcacatcttccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagtccaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaagcttgttttacagcttcctgccttgctgcctgtttcttcccaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcactctctcccctctccatcaccccataaaaccctcctgtcactttccttcagagacaccgctttggagagtattcccagcgctctccttgcttgtgacaagtaaaaaaaaaaaaaaactccttttcatca

SEQ ID NO: 880 - DNA, 3324 bp, Homo sapiens
gcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaagcggagacgtctacgtggagagggtccagggcaactcagtcttgttgcacatctcaaaactccagatgaaggatgctggcgagtatgagtgtcacacaccaaacactgatgagaaatactatggaagttacagtgcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccaggtttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcatgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaagtgatgttaaccaacacctttgacctgtcctgtgtcgtgagggccggttactctgacctcaaggtgccactcactgtgacgtggcagttccagccagctagctctcacatcttccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagtccaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcac

SEQ ID NO: 881 - DNA, 1444 bp, Homo sapiens
ctttgtctagtgggtccccctgtgcttttaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtattttcttttctcctaaatccacaaactctcttctttctctttggacagatgacctcttgtcatagttaagcagagagtgggcaggatattcctgataggaggaactacatgaataaaggggtaag

SEQ ID NO: 882 - DNA, 1421 bp, Homo sapiens
ccccagtctgagaacaagaaagaagaacttctgtctcgagggtctcactgtcaaccaggccagagtgcagtgaagatcatacctcactacatccgtgaactcccgggctcctcccacctaagtctcttgagtagctgggacttcagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagt

SEQ ID NO: 883 - DNA, 3389 bp, Homo sapiens
aacaagatgcaaggacaatctgaggactgagagccatttcaacgtgagcccccagtctgagaacaagaaagaagaacttctgtctcgagactgaagccaaggataccagcagagccaacatttgcttcaagttcctgggcctgctgacagcgtgcaggatgctgttggaacccggcagaggctgctgtgccctggccatcctgctggcaattgtggacatccagtctggtgagacagggaactacacagtgacgggattgaaacaaagacaacaccttgagttcagccataatgaaggcactctcagttcaggcttcctacaagaaaaggtctgggtaatgctggtcaccagccttgtggcccttcaaggtatgtccaaaagagccgtaagcaccccaagcaatgagggtgctattatatttctgccaccttggttattctccaggaggagaaggttggaaaggatgtccagggggagagaaaaatgttactcaagccctggctatccacaggaaagttcaaaccagtttcactgatccaaaggcactaaggaggaagacagataaatcagacttttcaatgggtaggaggtaagactcattaggaatgaaggcctgtgagagaggcaagttagtacaactacctctactcactgcatgaacagagggctacaagttgaagcaacagattttcagctattagaggaagaaaaggcaagagacagacttggtttggagatgggttttgaacaatgcggctcctcagcaaaggctgatggccagattgagtatattaaacacatgtagctgagtcctctgaaaaccatttaccaatatagattagcgttttccctattagataacaaaaagtgaaacttccaataatttgtcataacgtttttgcataacaagcaactgattcaggtttttgcctggccttggcattcttaactccattttatttaggcattcctcaaatcaataactaccactgttttgaatggcatcagaatgtaagctctatatatatgtaaggactttgtcttctttaccccaacgaaaagtcccacacatatggcaggctcttaataaatttgttaaaaaacctgtatgatgaatcagatgctttacacatgatgattctaaccttatacaacccttgcaagcaaacatcccctggttactcatcaggaaacagacacaaggaagttaaatagggcctggtgcggtggctcacgcctgtaatcccagcactttgggaggccaaggcaggcagatcctttgagcctaggagtttgaggccagtctgggcaacatggcaaaaccccaactatacaaaaaaatacaaaaattaggcatggtggcacacaactgtagtcccaagctaaggcatgaggatcacctgagcccaggctggttgaggttgcagtgagccatgatcatgccactgtactccagcctgggtgacagggtgagacactttctcaaaggaaaaaaaaaaaaaaaaagagttaattgttgcctgtcacagcaattaatacagatccttctcactctaaaaccttacactcagtaatgatctactatatgcaaagcacctcttacatccttcaccaccccattcattctgagattgactcctcccctttccagaaacaggaccacctaaacattccctattccagtcccttatttgcaagtcatcaaaagaaaacagagatttcaaaaagaaaacagagaccttatctgtaatccttggtaaggatcttccaaatttaagcctatgccagttttcaggaggaaacatgaatatgaaacagtctgacctttagacataattttttgttgactttaaattcccttggttaggccactgtaaccagtaaaataaattttattttagaataaaaattataaaggggaaattgagtctagccatacaacctactactagttactatctttgattcccaagtcatcctagagcaaaaaaaaaaaaaaaaaaaatcatctctggcctttttttccttttccactcaggtgaagagaatgagcttttgaatccaattttttgttttctcctatattcaattcaagtagctttaaagttaaccaaaggaaaaaaccaaagctcaatatttgattaaacgagaaaatatacactacttagaagctttcttttctttatccttcttccccaactcaaggcttagtagaattattgaaagaggtagtattcagtagaatagtacacatgctttttcaggtccagaaacaccacataggtcaagttatcatgcttacatgtggggaaaaggaggagggagtttcctggacctctgtgcctctctcagctcatgaactagtttcagtgaatatccttgtcttaccactgtgccaacaattcagagctatacgtggaaaacctaccttcaactttttgagtggcatctattgcttctttgattgttccttccagcaaggagcgatcaaaggctagcccccttcccactcccaccagaatcagatttgctcaagattacaaccctaatttagtaataagatgcaatacataaaatagttcccactttccttttccaatccctttacagtcatgagggcctatcacgcacgcatctcaggacaggtgagacttcattatatcaggtattttgttgctattctaagttataaggcagtaatacaaactttctttccacagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagt

SEQ ID NO: 884 - DNA, 704 bp, Homo sapiens
aacaagatgcaaggacaatctgaggactgagagccatttcaacgtgagcccccagtctgagaacaagaaagaagaacttctgtctcgagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaa

SEQ ID NO: 885 - DNA, 947 bp, Homo sapiens
gggacgcgcccggcagctgtccaccgatcccggccaccgcccccggccacccccaccccgcgagcccatggaggctccgggaccccgcgccttgcggactgcgctctgtggcggctgttgctgcctcctcctatgtgcccagctggctgtggctggtaaaggagctcgaggctttgggaggggagccctgatccgcctgaatatctggccggcggtccaaggggcctgcaaacagctggaggtctgtgagcactgcgtggagggagacagagcgcgcaatctctccagctgcatgtgggagcagtgccggccagaggagccaggacactgtgtggcccaatctgaggtggtcaaggaaggttgctccatctacaaccgctcagaggcatgtccaggtaagggggttcttgcacctaagccaagttgcatgggtctccccagccatagcctgccccccaggaggaaacagcctctctcaggcggtggattttgctcacccatacctgggcccggtatcagttctgcctttagctcactgagaagtcccctcctctctctgcctatttcctcatctgaaaattagtacaggtgtgtggaggggatgggagtgttagctcttcttctagtttaaggcatagcaaggactttggaagttcagagggaatgagagggagtgcttcctggaggaggtggcatcagtaatgagcctggaaggtagagatggagagagagcacatctggtggagggaactgtgtggggcttgcaagtatgttggatgtctagagtagggacagggctgcatctgaatcggaagtttagcggtgagtgggggctggggtcttgatgggagtcagggggtgggaaggctgctttgctatggatcacctgtctcctcagctgctcaccaccaccccacctatgaaccgaagacagtcacaacaggtga

SEQ ID NO: 886 - DNA, 1457 bp, Homo sapiens
acgcgcccggcagctgtccaccgatcccggccaccgcccccggccacccccaccccgcgagcccatggaggctccgggaccccgcgccttgcggactgcgctctgtggcggctgttgctgcctcctcctatgtgcccagctggctgtggctggtaaaggagctcgaggctttgggaggggagccctgatccgcctgaatatctggccggcggtccaaggggcctgcaaacagctggaggtctgtgagcactgcgtggagggagacagagcgcgcaatctctccagctgcatgtgggagcagtgccggccagaggagccaggacactgtgtggcccaatctgaggtggtcaaggaaggttgctccatctacaaccgctcagaggcatgtccagctgctcaccaccaccccacctatgaaccgaagacagtcacaacagggagccccccagtccctgaggcccacagccctggatttgacggggccagctttatcggaggtgtcgtgctggtgttgagcctacaggcggtggctttctttgtgctgcacttcctcaaggccaaggacagcacctaccagacgctgtgagtacctggccagcagcaagtacctgagtcccagctcacctcctggttcctgccccaccgttccccttcagtacccagggtgctgtcttctccatgggcaagccctcaggacggtgacagcgtgctccatgtgagccacaccccttttgtctcctccagttggggtgtttcctttgtcagatgttggctgggaccaggactcagcctgggccagtctaggagcccagctgagccctcctgtgtcttttcccttcatgctgccagcagggaagagaaccagtaggtgccagcccaggcaagcctgtggcccgcgtttctgtggctgtgggcaggagctgggccttgtgtctagttgggttttgctctgagaaggggagctgtgcctgaggccctctgtgtgccgtgtgtgctgtggggcgggtcgccacagcctgtgttaaagtgtttgctcttcctctgctgcctcctctcgaggcagggggtccttggctggctgaggcagtgtcaccttcctgagtgtcctctttggcctctgcagaatctgacccctttgggcctggactccatcctgaggggaaaggaggatgcagagggtggcctctgggcacccttgtgggtaagcggggggcgggggcgggaaaaactctggccgccagtttttggctcctgcgggcaccaagcaggctcagtgtctgatgcctgacatctcctcctgtcctgggcctggaacctgcagctgagaaaatccctcaaccacctcgtctcctccatcgcccctgctgggccccccagcctgacagtgggttgtatgcctgcctctttccaccaactggcctgggcactgcccccaaataaaggaactctgcactgca

SEQ ID NO: 887 - DNA, 993 bp, Homo sapiens
ccacgcccccacctggccacgccccggttgcccaggtctcgctccgcacacgctcagccgagcccagtctgggagggacgcgcccggcagctgtccaccgatcccggccaccgcccccggccacccccaccccgcgagcccatggaggctccgggaccccgcgccttgcggactgcgctctgtggcggctgttgctgcctcctcctatgtgcccagctggctgtggctggtaaaggagctcgaggctttgggaggggagccctgatccgcctgaatatctggccggcggtccaaggggcctgcaaacagctggaggtctgtgagcactgcgtggagggagacagagcgcgcaatctctccagctgcatgtgggagcagtgccggccagaggagccaggacactgtgtggcccaatctgaggtggtcaaggaaggttgctccatctacaaccgctcagaggcatgtccagctgctcaccaccaccccacctatgaaccgaagacagtcacaacagggagccccccagtccctgaggcccacagccctggatttgacggggccagctttatcggaggtgtcgtgctggtgttgagcctacaggcggtggctttctttgtgctgcacttcctcaaggccaaggacagcacctaccagacgctaatctgacccctttgggcctggactccatcctgaggggaaaggaggatgcagagggtggcctctgggcacccttgtgggtaagcggggggcgggggcgggaaaaactctggccgccagtttttggctcctgcgggcaccaagcaggctcagtgtctgatgcctgacatctcctcctgtcctgggcctggaacctgcagctgagaaaatccctcaaccacctcgtctcctccatcgcccctgctgggccccccagcctgacagtgggttgtatgcctgcctctttccaccaactggcctgggcactgcccccaaataaaggaactctgcactgca

SEQ ID NO: 888 - DNA, 2726 bp, Homo sapiens
acagagccacagaatgctgagcagtcaacagcatttcttgttccaagatcacccttctgagtacctctctggctgccaaattgccagggccttcacagtttgattccatttctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaacaaaacatataactgtgaaaatttaggtctcagtgaaatccctgacactctaccaaacacaacagaatttttggaattcagctttaattttttgcctacaattcacaatagaaccttcagcagactcatgaatcttacctttttggatttaactaggtgccagattaactggatacatgaagacacttttcaaagccatcatcaattaagcacacttgtgttaactggaaatcccctgatattcatggcagaaacatcgcttaatgggcccaagtcactgaagcatcttttcttaatccaaacgggaatatccaatctcgagtttattccagtgcacaatctggaaaacttggaaagcttgtatcttggaagcaaccatatttcctccattaagttccccaaagacttcccagcacggaatctgaaagtactggattttcagaataatgctatacactacatctctagagaagacatgaggtctctggagcaggccatcaacctaagcctgaacttcaatggcaataatgttaaaggtattgagcttggggcttttgattcaacgatcttccaaagtttgaactttggaggaactccaaatttgtctgttatattcaatggtctgcagaactctactactcagtctctctggctgggaacatttgaggacattgatgacgaagatattagttcagccatgctcaagggactctgtgaaatgtctgttgagagcctcaacctgcaggaacaccgcttctctgacatctcatccaccacatttcagtgcttcacccaactccaagaattggatctgacagcaactcacttgaaagggttaccctctgggatgaagggtctgaacttgctcaagaaattagttctcagtgtaaatcatttcgatcaattgtgtcaaatcagtgctgccaatttcccctcccttacacacctctacatcagaggcaacgtgaagaaacttcaccttggtgttggctgcttggagaaactaggaaaccttcagacacttgatttaagccataatgacatagaggcttctgactgctgcagtctgcaactcaaaaacctgtcccacttgcaaaccttaaacctgagccacaatgagcctcttggtctccagagtcaggcattcaaagaatgtcctcagctagaactcctcgatttggcatttacccgcttacacattaatgctccacaaagtcccttccaaaacctccatttccttcaggttctgaatctcacttactgcttccttgataccagcaatcagcatcttctagcaggcctaccagttctccggcatctcaacttaaaagggaatcactttcaagatgggactatcacgaagaccaacctacttcagaccgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctgatgtcaagctttcctgtgggattacagccataggcattttctttctcatagtatttctattattgttggctattctgctattttttgcagttaaataccttctcaggtggaaataccaacacatttagtgctgaaggtttccagagaaagcaaataagtgtgcttagcaaaattgctctaagtgaaagaactgtcatctgctggtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagagggagggactgggcagggactgccggccccggagtctcccacagggaggccattccccttctactcaccgacatccctcccagcaccacacaccccgcccctgaaaggagatcatcagcccccacaatttgtcagagctgaagccagcccactacccacccccactacagcattgtgcttgggtctgggttctcagtaatgtagccatttgagaaacttacttggggacaaagtctcaatccttattttaaatgaaaaaagaaaagaaaagcataataaatttaaaagaaaaggctgagaaatgaaa

SEQ ID NO: 889 - DNA, 1296 bp, Homo sapiens
caaaactcactgacatttcccatcagtggttaatcagtcaaaaacatatagaatgacagcaaaaattaaagataagcaagataatgaagaaatatgttttgcaatcctgttgaagacagaataagcaaaagtgaccaagagaaacagattcaccaagtctgttgattgatttaaagtggatttatgtttaagtagaaaaccactccaaaagcatactttagggaagatgtcagctccaagattactgatttccatcattatcatggtgtctgcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcgtccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactgatcattctttatgtgaaactctctctttttgtggtcattctggtcaccacaggatttgttttcttccagaggataaatcatgtcagaaaagttctttaaagaagaaggaagggtcttcttttgcttctcctccttgtctctggactgcaacattggtgagatgagtgatggtccagcagtgaacttgggccatggatgatgttaaggatagaagccactcagtaggatagaagaaaagaaagatggaagaaggatcctgggcttgatgaccatgaagtttccctataaaccctcaaccacctattcattgacttcttttgtgttagagtgaataaaattttgttcatgccagt

SEQ ID NO: 890 - DNA, 1365 bp, Homo sapiens
caaaactcactgacatttcccatcagtggttaatcagtcaaaaacatatagaatgacagcaaaaattaaagataagcaagataatgaagaaatatgttttgcaatcctgttgaagacagaataagcaaaagtgaccaagagaaacagattcaccaagtctgttgattgatttaaagtggatttatgtttaagtagaaaaccactccaaaagcatactttagggaagatgtcagctccaagattactgatttccatcattatcatggtgtctgcctcagataataattcctgtctgatgacacaactggaaatacaaagttagagaatacgtcttaatgaagcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcgtccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactgatcattctttatgtgaaactctctctttttgtggtcattctggtcaccacaggatttgttttcttccagaggataaatcatgtcagaaaagttctttaaagaagaaggaagggtcttcttttgcttctcctccttgtctctggactgcaacattggtgagatgagtgatggtccagcagtgaacttgggccatggatgatgttaaggatagaagccactcagtaggatagaagaaaagaaagatggaagaaggatcctgggcttgatgaccatgaagtttccctataaaccctcaaccacctattcattgacttcttttgtgttagagtgaataaaattttgttcatgccagt

SEQ ID NO: 891 - DNA, 1597 bp, Homo sapiens
aacatcactcagatctctgccttttatcttcacatggtgttcctgtgtatgcgcccagttttcctctttttataaggacaccataaaaagctaagaagtgcaaaagaagaaaaaaagaataaaccaaagacgccagtcatattggattagggaccaatctatttcagcatggccacatcttaactaattatatctccaatgaccctatttccaaataaggtcatcttctgagcaaaactcactgacatttcccatcagtggttaatcagtcaaaaacatatagaatgacagcaaaaattaaagataagcaagataatgaagaaatatgttttgcaatcctgttgaagacagaataagcaaaagtgaccaagagaaacagattcaccaagtctgttgattgatttaaagtggatttatgtttaagtagaaaaccactccaaaagcatactttagggaagatgtcagctccaagattactgatttccatcattatcatggtgtctgcctcagataataattcctgtctgatgacacaactggaaatacaaagttagagaatacgtcttaatgaagcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcgtccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactgatcattctttatgtgaaactctctctttttgtggtcattctggtcaccacaggatttgttttcttccagaggataaatcatgtcagaaaagttctttaaagaagaaggaagggtcttcttttgcttctcctccttgtctctggactgcaacattggtgagatgagtgatggtccagcagtgaacttgggccatggatgatgttaaggatagaagccactcagtaggatagaagaaaagaaagatggaagaaggatcctgggcttgatgaccatgaagtttccctataaaccctcaaccacctattcattgacttcttttgtgttagagtgaataaaattttgttcatgccagt

SEQ ID NO: 892 - DNA, 3343 bp, Homo sapiens
ggcgcaacgctgagcagctggcgcgtcccgcgcggccccagttctgcgcagcttcccgaggctccgcaccagccgcgcttctgtccgcctgcagggcattccagaaagatgaggatatttgctgtctttatattcatgacctactggcatttgctgaacgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagtt

SEQ ID NO: 893 - DNA, 3644 bp, Homo sapiens
gcgtcccgcgcggccccagttctgcgcagcttcccgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaa

SEQ ID NO: 894 - DNA, 1303 bp, Homo sapiens
gttgacttccgagcttggattcaagtccctgaagggcaccagacacctgtgatcaccaaggagaggagaggagacaggaccatgtggctgtccccatctctgctgcttctcatcctcccaggttactccattgccgctaaaatcactggtccaacaacagtgaatggctcggagcagggctcattgactgtgcagtgtgcttatggctcaggctgggagacctacttgaagtggcggtgtcaaggagctgattggaattactgtaacatccttgttaaaacaaatggatcagagcaggaggtaaagaagaatcgagtttccatcagggacaatcagaaaaaccacgtgttcaccgtgaccatggagaatctcaaaagagatgatgctgacagttattggtgtgggactgagagacctggaattgatcttggggtcaaagttcaagtgaccattaacccaggcacacaaactgcagtctcagaatggacaaccacaacagcaagcctggctttcacagctgcagccacccagaagaccagcagccccctcaccaggtccccgctcaagagcacccacttcctgttcctgttcctcctggagctgcctctgctcctgagcatgctggggaccgtcctctgggtaaacagaccacaaagaaggtcttgaaggaggaggagtcagcccgatgatgagagtcccaatgcccattgacgtcctgtccagggcgaaaggccctcccacagaagaaaaaacattttcttttctcttctttttttctttctagagatagagtcttgctctgtcacccaggctggaatgcaatggtgtaatctctgctcactgcaactttcccctcccaggctcaagcgatcctcctgcctcaacctccagagtagctggggctacaggcacatgccaccacccccagctaatttttaaatttttttgtagagatgggcttccaccacgttgcccaggctggtctcgaactcttgacctcaagagatcctcccgcttcgcctcccaaagtggtgggattacaggtgtgagccaccgcacctggcagaaaaacaacatttctatggggaattgactgtggttctagaggcagtgctggccccagcttcagggaacagcctcctagtcccctatctcctgcagccgtgccacctggggctattcccttctctgcacagtccctggggcctgacagagcccttcttccttctgaggtctccaatgcagtagaaaacatgagaagaatgtgtttcccccgagaggcacctatgccgtagtggacatt

SEQ ID NO: 895 - DNA, 996 bp, Homo sapiens
aaagacccgtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctgcctctcacgcttgaatcacagaacatcagagctggatccagatgaagcctttgagatctctagcctgacttttctctcagtttgaagcaaatcgcctttcagaacgcccaggggtcagggagctgttagagatgcactctccagggccccagacccagctgaaccctccaggggtggggtccagggactctggcagtgctacaaactctagtgtgcttttacaaaagatgagactgaggcccagagagggtaaaggtcttgcccatggtcacacagcaggtggtggcccaaacagagaacaggacccaga

SEQ ID NO: 896 - DNA, 2783 bp, Homo sapiens
aaagacccgtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccaggaccctgctgtcctccctccccttctcccaccttccagcctctggctacaacacgcctgcagcccaaggcaaaagctcagcaaacccagcccccaggattgacttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctgcctctcacgcttgactgcggaggaaaaggaagccccttcccaggcccctgagggggacgtgatctcgatgcctcccctccacacatctgaggaggagctgggcttctcgaagtttgtctcagcgtagggcaggaggccctcctggccaggccagcagtgaagcagtatggctggctggatcagcaccgattcccgaaagctttccacctcagcctcagagtccagctgcccggactccagggctctccccaccctccccaggctctcctcttgcatgttccagcctgacctagaagcgtttgtcagccctggagcccagagcggtggccttgctcttccggctggagactgggacatccctgataggttcacatccctgggcagagtaccaggctgctgaccctcagcagggccagacaaggctcagtggatctggtctgagtttcaatctgccaggaactcctgggcctcatgcccagtgtcggaccctgccttcctcccactccagaccccaccttgtcttccctccctggcgtcctcagacttagtcccacggtctcctgcatcagctggtgatgaagaggagcatgctggggtgagactgggattctggcttctctttgaaccacctgcatcccagcccttcaggaagcctgtgaaaaacgtgattcctgggccccaccaagacccaccaaaaccatctctggggcttggtgcaggactctgaatttctaacaatgcccagtgactgtcgcacttgagtttgagggccagtgggcctgatgaacgctcagacccctccagcttagagtctgcatttgggctgtgacgtctcccacctgccccaataagatctgctctgtctgcgacaccaagatccagctggggactcccctgaggcctgcctaagtccaggccttggtcaggtcaggtgcacattgcagggataagcccaggaccggcagagagtggttgcctttccatttgccctccctggccatgccttcttgcctttggaaaaatgatgaagaaaaccttggctccttccttgtctggaaagggttacttgcctatgggttctggtggctagagagaaaagtagaaaaccagagtgcacgtaggtgtctaacacagaggagagtaggaacagggcggatacctgaaggtgactccgagtccagccccctggagaaggggtcgggggtgggggtaaagtagcacaactactattttttttctttttccattattattgttttttaagacagaatctcgtgctgctgcccaggctggagtgcagtggcacgatctgcaaactccgcctcctgggttcaagtgattcttctgcctcagcctcccgagtagctgggattacaggcacgcaccaccacacctggctaatttttgtacttttagtagagatggggtttcaccatgttggccaggctggtcttgaactcctgacctcaaatgagcctcctgcttcagtctcccaaattgccgggattacaggcatgagccactgtgtctggccctatttcctttaaaaagtgaaattaagagttgttcagtatgcaaaacttggaaagatggaggagaaaaagaaaaggaagaaaaaaatgtcacccatagtctcaccagagactatcattatttcgttttgttgtacttccttccactcttttcttcttcacataatttgccggtgttctttttacagagcaattatcttgtatatacaactttgtatcctgccttttccaccttatcgttccatcactttattccagcacttctctgtgttttacagacctttttataaataaaatgttcatcagctgc

SEQ ID NO: 897 - DNA, 1297 bp, Homo sapiens
aaagacccgtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccagcttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctgcctctcacgcttgaactccctgatgttttctctgagcctgccttggctctgagaccaaggtggtgtggctgctctgggacccaggctgagggtggtgctctggggaccaggggcaagagaataagggtccctgtgcccattgtctggagctgggaacctgccccaaggctactgctgcaagaagagactgtgccctccgaggccagcactccaacggagggggctgcagcatcgcacttcaggcaacagaagcccctcctggcccctcctccctctgctgtttactgagatgcctccactccattcctttaaacacaagggcaggaaagcggagctaccattgccttctttcctggcgccagtgaggacaaaagactcaggcctggtcaccccaaggagggtctggggtggaaatgggactttgggctgtggcttaggaagcagctgttgttgtctca

SEQ ID NO: 898 - DNA, 1399 bp, Homo sapiens
aaagacccgtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccaggaccctgctgtcctccctccccttctcccaccttccagcctctggctacaacacgcctgcagcccaaggcaaaagctcagcaaacccagcccccaggattgacttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctgcctctcacgcttgaactccctgatgttttctctgagcctgccttggctctgagaccaaggtggtgtggctgctctgggacccaggctgagggtggtgctctggggaccaggggcaagagaataagggtccctgtgcccattgtctggagctgggaacctgccccaaggctactgctgcaagaagagactgtgccctccgaggccagcactccaacggagggggctgcagcatcgcacttcaggcaacagaagcccctcctggcccctcctccctctgctgtttactgagatgcctccactccattcctttaaacacaagggcaggaaagcggagctaccattgccttctttcctggcgccagtgaggacaaaagactcaggcctggtcaccccaaggagggtctggggtggaaatgggactttgggctgtggcttaggaagcagctgttgttgtctca

SEQ ID NO: 899 - DNA, 631 bp, Homo sapiens
caagtgccgcctgtgctggggaagggaccatgtggctgccttgggctctgttgcttctctgggtcccagcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggcccca

SEQ ID NO: 900 - DNA, 1856 bp, Homo sapiens
gctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaa

SEQ ID NO: 901 - DNA, 1295 bp, Homo sapiens
cggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttattt

SEQ ID NO: 902 - DNA, 1163 bp, Homo sapiens
agggcctggagctgctgcaagtgccgcctgtgctggggaagggaccatgtggctgccttgggctctgttgcttctctgggtcccagcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaa

SEQ ID NO: 903 - DNA, 1517 bp, Homo sapiens
gaaatggcccagcttggctctgccttctgcagtgtgagtaacacactgaagccagaagctgtgggctgtggggaagtggctgcatcgccacccaagggaccctggactttgccagacgtcagggttgagaggagccactagcaccatcccagagctgtcagcaccggcctcagcccaggcggctctctccctgagcttcctgtaccctgaccctctccagcctcagacctgagacagggctggacaaggaagcagagagcagaagaaaagcagaagcgaagctcagatctgctgggaggagattacattttgtcccctcctggggtcttgcacagtggcaggtgacattcgtgttacaggaatgactgccagggcctgggcctcgtggcggtcttcagctctgctcctcctgcttgtcccaggctattttcctctgagccaccccatgaccgtggcgggccccgtggggggatccctgagtgtgcagtgtcgctatgagaaggaacacaggaccctcaacaaattctggtgcagaccaccacagattctccgatgtgacaagattgtggagaccaaagggtcagcagggaaaaggaatggccgagtgtccatcagggacagtcctgcaaacctcagcttcacagtgaccctggagaatctcacagaggaggacgcaggcacctactggtgtggggtggatacaccgtggctccgagactttcatgatcccattgtcgaggttgaggtgtccgtgttcccggccgggacgaccacagcctccagcccccagagctccatgggcacctcaggtcctcccacgaagctgcccgtgcacacctggcccagcgtgaccagaaaggacagccccgaacccagcccacaccctggctccctgttcagcaatgtccgcttcctgctcctggtcctcttggagctgcccctgctcctgagcatgctgggtgccgtcctctgggtgaacagacctcagagaagctctagaagcaggcagaattggcccaagggtgagaaccagtagcatctgctgtccatcaaggccctgtgctgcaacagagcccctctgggggactggaatgacctcctgaccactccctcccgggctgctctctccacatctcctggaatcctttgtgagcctccttcagccttttccctgtgcccgatcctcatgtgtcacatgtgaacctgacggacatggacgccctgagctgtgagtccacgtctcatgtgcacgccccggccagctaagcctcgggccgtcagcaatacctctgagtgcccggatgccctccctgcacccttccatttctccaggagcctggcactgcttcctccaccgttttcacagggagaagcaggtctaggactcccctgcacctttgccaccataatggcccacactccctgggtccaggagtgtagaatatgcggctgcttccatttgctgagtgtgtcgattcaatgatgctttcaaactttaataaatgacaatgtgtagg

SEQ ID NO: 904 - DNA, 739 bp, Homo sapiens
gacctagatttgctgaggacggaagccaaggagacaggaacatgtggctgctcccagctctactccttctctgcctctcaggctgtttgtctctgaagggccccggctctgtgactggcactgcgggggactctctgacagtgtggtgtcagtatgagagcatgtacaagggatataacaagtactggtgccgaggacagtacgacacgtcatgtgagagcattgtggagaccaagggagaagagaaggtggagaggaatggccgcgtgtccatcagagaccacccggaggctctcgccttcactgtgaccatgcagaacctcaatgaagatgatgctggatcttactggtgcaaaattcagacagtgtgggtcctggattcatggtcacgcgatccctcggacctggttagggtgtatgtttccccagcaattacaaccccaaggaggaccacacatccagccacacctcccatcttcctggtggtgaaccctgggcgaaacctcagcaccggggaggtgttgacccaaaattcagggttccggctcagcagccctcacttcctgctcgtggtccttctgaagctgcccctgctcctgagcatgctgggtgctgtcttctgggtgaacaggcctcagtgggctcctcctggaagatagagccaggctgacccgaagccctgcagagccccatccccaggagtgccccgtgcagggagtcaacctttcagactggatgc

SEQ ID NO: 905 - DNA, 3501 bp, Homo sapiens
gagaacacaaaggaaacttggacaagtagaaagtggatgacccaggctccgttacatatacttggattccagctgggacctagatttgctgaggacggaagccaaggagacaggaacatgtggctgctcccagctctactccttctctgcctctcaggctgtttgtctctgaagggccccggctctgtgactggcactgcgggggactctctgacagtgtggtgtcagtatgagagcatgtacaagggatataacaagtactggtgccgaggacagtacgacacgtcatgtgagagcattgtggagaccaagggagaagagaaggtggagaggaatggccgcgtgtccatcagagaccacccggaggctctcgccttcactgtgaccatgcagaacctcaatgaagatgatgctggatcttactggtgcaaaattcagacagtgtgggtcctggattcatggtcacgcgatccctcggacctggttagggtgtatgtttccccagcaattacaaccccaaggaggaccacacatccagccacacctcccatcttcctggtggtgaaccctgggcgaaacctcagcaccggggaggtgttgacccaaaattcagggttccggctcagcagccctcacttcctgctcgtggtccttctgaagctgcccctgctcctgagcatgctgggtgctgtcttctgggtgaacaggcctcagtgggctcctcctggaagatagagccaggctgacccgaagccctgcagagccccatccccaggagtgccccgtgcagggagtcaacctttcagactggatgcgagagacctgtggactctggagggatttattgttcctgtgcctcaaaggagggtcctggctcttagaggacactcctctggagtcctcaatgtgcagcttgggggtcctcctttctcctccccagtcccctgcctccctgccctcatgcccacttcccaagggcaagaattccctggaagttggccgggcaccatagcgagtgcctataatcccagctcaggaggctgaggcaggaggatcggctgaacgtaagagttccaggccagcctgggcaacatagagagccctgtctcagagagagagagagagagagagagagagagacagagagagagagagagagagagcgagagagagagagagagagagaaaaggacggaggaagggagggaaaaaattttctggaggagcctggcccttcattcttcttggcacaaatgcttctcaggccagtttcccccagggcaataactacctccttcctgcagacaggagtctccctgaggacacacccctcacagccccagcctttaggctcacagagctccatctcttctctgggacaaccccaagggagcttggtcccggcagagcttgctcatgcagttgcccagtgtcccacatgctcagggctcctctcgtcttctgacgccccttgggtctccctggctttaaggccccttctctccctgtaaccaggcagtgtgtggctgggctcagaacatctctgcctgggtgggccgtggatgagctgctccaggttaaagttctggggcgagttgaaacagtaaagggagaaggagctggtgggtgcccctgatatcactcctggaattcccccacctggaggtgtccaatgcacaaggtcaacagagtcagttctgtccactttagaagtctggctgagaccacctgttagcaattaaccttttccacaggcagagcagatatcgtttttcaaagacaggatggagggcacagaggtgaaggatacttgtccacacttgaagtgcacagtgctatcaccactactggtgacccctggctcgggaatgagctcagttggttttctgaatgtttgtcaattactctgtttccctaaagtttgtggggaggactcccacagtctgccacaagcaagcatcaccatctccacttgctacctacatctggaccagtgctccccctctgcccccaggcctgagctcatcctgagctagtgatgccagtgtccagagcacatggagtgaccctctgagtgccgagtgcttaggcagagctgccgtgctctgaacttgagctctggtggggctcccagctccatcatgcatggtgactaggggaaagatggggctggcccaggactcatgctgaaagagaaattcaatctaacaaggcccatattaattatattaacccgggaaatatgatgatgagcaagaaaggagcttatgattcattttatgagaaggataagctcccaagtcattacagcataggaagaactctagagccacaagagatgcttcctgatgtcagggggttggtgaggagaatatcatgccaagctggccaggtcagggaaagaaggtgacattcatgttgatgttgaaggaggtataggatttcagcggagcagggatggagcaacagggagagagagaggacagagaaacagcataagtgaaagcagagaggcgggaaataatcttcataacaatagtcacttatagaagacctatcagcaaatggactgtactgttcacatacagatgctcatggtaggatgtgtctaagattccaatggagtgaaattttcctgtggcaggccagatggaactaatctagaagaactcaggtggtggcaggttcaggaggcttaggactcaactcttacttaaactttgattagctatggtgggatggatttgagcagaacaagatgggattgcagatgtgctttaggaggacttgcctagcagatgtagcaaagtctgaaaggaagaatctgggagtccggagtcttaagcctggaaaaccagaggaatcgggcatcattgacagaagtaggaaagtcaagagcaggcttggatgatgcagagcttagttttctgtgtgtttggaatcatcaggcagagaggtctagcagatagctagagatgtgggttagcagagtgttgagggctggagaggaatgtgtgtagagagattaactggaacccagcaagaagtgaaaacatggagggaagagttcagaaccaaggacagagccctcggggcacctgcatttaaagacaaagggtaggaggaagacattgatcaaggtgctggagcagaatcaaacaggtggaagatgagaagtcaagagccatgaatgtttcaaggaggagagcagagctagagaggtggaggaggaccgggattgagaggaggctattgaacttatcattcacaaggtcactaatgaagttcagaagagcagatcaacagagcaatgacagcagaagccagaagagaagagttaagaaagagtagacagatggcagacagcaggtgcaggagaaacaaacagtggcttctccatgctttgaattttcccttctcccttactccctttttttcccctattcttcctttcttttttccctttatttactcattcattcaataaacttttattgtgtg

SEQ ID NO: 906 - DNA, 570 bp, Homo sapiens
ctctgaagggactggctctgatcctagcagaagaagaacaaccccaagctctccagcaaggatccctttaggaagcagcacaagcaggccccggctccatcaccagactcttggctgtgacaagccctttgtaccctgccaagctcccactgtgggaaatgcagtcctgagctctgtccagaacctagaaggaggtgctgctgggatgtgccacctccaggaggaagctgggggcaggtggaagggaggaggctgtttgtctctgaagggccccggctctgtgactggcactgcgggggactctctgacagtgtggtgtcagtatgagagcatgtacaagggatataacaagtactggtgccgaggacagtacgacacgtcatgtgagagcattgtggagaccaagggagaagagaaggtggagaggaatggccgcgtgtccatcagagaccacccggaggctctcgccttcactgtgaccatgcagaacctcaatgaagatgatgctggatcttactggtgcaaaattcagacagtgtgggtcctggattcatggtcacgcgatccctc

SEQ ID NO: 907 - DNA, 1206 bp, Homo sapiens
aaaagaggaaatagatgagtgagaacacaaaggaaacttggacaagtagaaagtggatgacccaggctccgttacatatacttggattccagctgggacctagatttgctgaggacggaagccaaggagacaggaacatgtggctgctcccagctctactccttctctgcctctcaggctgtttgtctctgaagggccccggctctgtgactggcactgcgggggactctctgacagtgtggtgtcagtatgagagcatgtacaagggatataacaagtactggtgccgaggacagtacgacacgtcatgtgagagcattgtggagaccaagggagaagagaaggtggagaggaatggccgcgtgtccatcagagaccacccggaggctctcgccttcactgtgaccatgcagaacctcaatgaagatgatgctggatcttactggtgcaaaattcagacagtgtgggtcctggattcatggtcacgcgatccctcggacctggttagggtgtatgtttccccagcaattacaaccccaaggaggaccacacatccagccacacctcccatcttcctggtggtgaaccctgggcgaaacctcagcaccggggaggtgttgacccaaaattcagggttccggctcagcagccctcacttcctgctcgtggtccttctgaagctgcccctgctcctgagcatgctgggtgctgtcttctgggtgaacaggcctcagtgggctcctcctggaagatagagccaggctgacccgaagccctgcagagccccatccccaggagtgccccgtgcagggagtcaacctttcagactggatgcgagagacctgtggactctggagggatttattgttcctgtgcctcaaaggagggtcctggctcttagaggacactcctctggagtcctcaatgtgcagcttgggggtcctcctttctcctccccagtcccctgcctccctgccctcatgcccacttcccaagggcaagaattccctggaagttggccgggcaccatagcgagtgcctataatcccagctcaggaggctgaggcaggaggatcggctgaacgtaagagttccaggccagcctgggcaacatagagagccctgtctcagagagagagagagagagagagagagagagacagagagagagagagagagagagcgagagagagagagagagagaga

SEQ ID NO: 908 - DNA, 545 bp, Homo sapiens
cttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaag

SEQ ID NO: 909 - DNA, 468 bp, Homo sapiens
cagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcaacataagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgca

SEQ ID NO: 910 - DNA, 1116 bp, Homo sapiens
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggttcctgcttgaacaccttcactaagaacccttatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggct

SEQ ID NO: 911 - DNA, 1298 bp, Homo sapiens
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggtaaaatgtggaaactcaccttctctcctcctgggactgaagccatttatccaaggtttagctgaaaggcccattgttccagggaatctgcctttttccgatctccaccccaccacctcccagaatgatggctctgaggatggtatgacattaccctgaatggtcttcagaatccattcctgagatcaccagtagctggtgggcccagaacatgggttcgagcttagtacatacatgaacaagctgtgcttcactgtacgagtgtgttcacctttccagctcagggccctcacatgtgaaatgtttggactagaggatctccagggtcacttccaatttcattgtattttgattatgactattggagagtcattgagaaacatatactaatcctgtactccatggttgtcactatgtccctctgaatccctctggatcattctgtagttgtgc

SEQ ID NO: 912 - DNA, 856 bp, Homo sapiens
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcaggtaaccagctctgcccatctctcctggtgagtctcagagatcactctgaggagctgcaaggtctgaacgtgggccacattctctagggagatgtgcttcctttatctttggcctggtcactgagggcatcacctcccaagaagcctact

SEQ ID NO: 913 - DNA, 1098 bp, Homo sapiens
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggttcctgcttgaacaccttcactaagaacccttatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggct

SEQ ID NO: 914 - DNA, 965 bp, Homo sapiens
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtgcttccctccaaggaagagccagtgaacacagtttattccgaagtgcagtttgctgataagatggggaaagccagcacacaggacagtaaacctcctgggacttcaagctatgaaattgtgatctaggctgctggg

SEQ ID NO: 915 - DNA, 8181 bp, Homo sapiens
ccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaagatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgccctcaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagacagagtgagactccatctcgaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaaaccccatctgtacttaaaatacaaaaaaattagctgggcgtggtggtgcacacctgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaaggcactttggagggagaagactttcagagttaggcagaccaactaagaggtcagctgaagcacctaaccagttgtaaggaggtgaaagacagcaccccaagaagagacgtgcaggaaggaggaaagaggcttggtcataaaggatggaggaattccaaagtgacactgaacaggctgcgtttatcctaaaataaaaccactcctcactctgtggatgcgttgaagactcattcccaaacatctttattctctaacttgccctcttcctcttcctaatatgctcactcaagtaaaattactagtgtcctaatgcccctatgcatattgtcaaaaataaaaatcagaagcaggttagatctgttaggtcttccagaagagcaaacctgggatgaagccagagcccaggaattctgaaggtagcctttggactcaggacaccctactcttgtctctcctctcagtttctctgctatgaatctcctgattcatgaacacgttatctgttcacccttctctctaggtcttagttcttagattttccttctgtaaaatgcatgtgatcttattttcccctccacaactttccagatgaactagactgtgaccaagaggtctataaaatcaaagcatcatggaacaggatcttgtatcagaccaaagtgtgccagtttttaaaaatgtgcatcaaaatggaagtctcagagacagagccctctggtggaaagttctagtaggttaggacagtcctgcctgcagacaccttgggctttactgagggactcaactgagaaaatgaggaatgttgcagctcatgattcttagaagaagaaagtgaagcttgtttaaaatatgatttaaaaaatctgtagaacactgtaaactacacaggctatgagggaatagcctggttgggccagcttggaaatcgggcacaggcaggaaggggcctgtctggtttgggccgtgtccacagagagcacttcttaggtcctgcctggagagaaggaatggctgggctatattttcttccagactcattatttttcttctgtttgacttttctctgaatttcccttgatttgtataaattttctcaataattagtgacagtgtctactgattgtaaaatgaagcttgaaggccaggcgcagtggctcatgcctgtaatcctagaattttgggaggccaaggtgggtggatcacaaggagttcgagaccagcctggccaaggttgtgaaaccgcgtctctactaaaaatacaaaaaaattagccgggcatggtggcacgtgcctgtagtcccagctactcaggaagctgaggcaacagaatcacttgaacctgggaggtggaggttgcagtgagccgagatcacgccactgcactccagcctgggcgagagagtgagactccgtctcaaaaaaaaaaaaaaaaaaaaaagtttgaagaacaaagacaataagaggaaatataatgagtggtcataaatgtgggctctgacagtagagtgcctgggtctgcatcctggtttcttagtcatgtgaccttaggcaagttactttaacctcgctgtacctcaggttgtccatctgtaaaatggggataataatagtgcctaccttttaaggttgatgtggggattaaatgaggtgttgctcatacaggaatgtgcctgtgcatggcaaagttcgggaaattttttataagctgttctaggcctgaaatcttcagaagatgctaatctaaattcatgaaataagcttcttacaacagaaatgctgctagtattatgcaaaattaatgttgtatatcaaacttttaactctcatccctccttattcagatatattttgttataagcaatgtttgttcccctcgttattataccacagtctacttacctgatgctatatctgcctccccagttagactgagagaacaggggatatacctaaataataataataataataataataataaataataatggagagctccttgaagatagggagcctgtaagaatcattgagggcttattttgtataccaactgctaaactagatgcttcatacattgttgtcaatactcatgacagccttgtaaagtagaaattaattcttccagttaacactaaggctgacatatgaataccttggcaaatctggaaagctgggaagacagtatttgaattcaagacttcttgtcaccaagggccatgcacttgtactctgccatgtggcccttttttacctcctgtggattctccctacctggtacttggccttaggtgtacacacacctggcactttgcttgacacataataggtggaccacaaatatctactaaatgaatatttgcatatagtaatattttaaggtactaaaagcagctcaaagtaaatatattaatatattaattccattgctatctggataaccactcaactttcctgctgaaaatgcccatttaattaaagaaggttggatagagctctctatatgcattttggacaggcaggggtttcaggtcataaacattctgatgagttaatataaaataagagaaactgtaaatttccactactaaaaatcacaaaaataacagaaacaaaagaagagataagaatttggggaattgtgctgaacaatttagtggttaaaaaaaacaactgtgcatgtttagacttaaataagcccccatccaagtgtgaggggtccagtaatttttcaaaacatatgaaagtgttaatacatttcgacaaaggaccattaaaaaagtcctgaattctgacttgagggaggaaagtaatgactaatacattctctagagacttgcagactttgggaattcataaaggaatggatgataattattaactgttgctggctgattgcccagacagttctcaacagccctgtacaagtctctgggtttgggatggatcaattctgagactggaaaatggccaaatctttgcaaatgagaaatatttttcttataagttcttattgtaggcaaataattacatagattattcatcagagaatttttaaatgctcataatctcaactctttcatttacaacttgtatttccaatagtttatgggtcatctctgcatagatgtcagaagtcacctcaagtttagcgtgtccaaaatctaactcacaggtctgtttctgacctcccaacttgctttccttgtgtttttcctatgctaatgatccaccataatcaaaataattaacatttatccagtgcctactatgtactattccctgtcctgttttacatttactcatttaaagtccataagaaacattaaatctcatctgccttctgaagaagatacaaccatgctctcttttacaaagtaggaaactgggtcacagaaaggtgaagtctttaaggctgaatcacagtagctcatcctagtaaatagaaaagccaggattcaactccaggggctgggtgcagaactgctattcttcactgcttcaccaatcagcagctacccaaggcagaaaactttttcatccttggctccttcattctccctgtcaccccagatcccctctacatctagtcagagaataggtcctgtcaattccaacttctctatatggctcctctcaggcatgtgcccttaattggcctaattctctaatacaccttccctctacatgctcactccctcagatcattgctttatcacgtgttacctgggttgctattacataaagagcaatctttctaaaatgaggatcttatcacttcacttccacactaaaatgtttttcctggggaaccacactccttagcaatctgacccatcagaccttccaggctgtctcctgcctgctccctaaggctccagccacacagaattatcatgggcccacacacccaccaaatcctcccatgcctttgcccatgttgtctgggatgcccttctctcccttctgtctacatcaagcatcagactgaatatccctcttgtgcggccttctaaaacctcccgtccaaagcgaaatatattgccctctatttatacttttacagcatttggcacacaagtacagagtagtagctttttatcacattctctgataattatatagatatggtatttcttagctctctctccaactggctaataagttgctttttgtctgagtgcctaattttgtgttttgtgtctgagtgcctcagttcctcaaaaaaaggttttttgattagttcattattcatttgaacatggaaattatgctcactagtggcaaatgccactaaccgtattccagaagctaggtgtcatgtttgcaataagatatattatcccttctacaagtcaccttttatttcaggcatttgtaaatgcccattaataaagtatggttcataaattttaccttgtaagtgcctaagaaatgagactacaagctccatttcagcaggacacaataaatattattttataatgca

SEQ ID NO: 916 - DNA, 7885 bp, Homo sapiens
ggaggaagaaaactcaagtgaaactgactctgctagaacagtgccgtgcttttccacagaaggttagaccctgaaagagatggctcagcaccacctatggatcttgctcctttgcctgcaaacctgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaagatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgccctcaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagacagagtgagactccatctcgaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaaaccccatctgtacttaaaatacaaaaaaattagctgggcgtggtggtgcacacctgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaaggcactttggagggagaagactttcagagttaggcagaccaactaagaggtcagctgaagcacctaaccagttgtaaggaggtgaaagacagcaccccaagaagagacgtgcaggaaggaggaaagaggcttggtcataaaggatggaggaattccaaagtgacactgaacaggctgcgtttatcctaaaataaaaccactcctcactctgtggatgcgttgaagactcattcccaaacatctttattctctaacttgccctcttcctcttcctaatatgctcactcaagtaaaattactagtgtcctaatgcccctatgcatattgtcaaaaataaaaatcagaagcaggttagatctgttaggtcttccagaagagcaaacctgggatgaagccagagcccaggaattctgaaggtagcctttggactcaggacaccctactcttgtctctcctctcagtttctctgctatgaatctcctgattcatgaacacgttatctgttcacccttctctctaggtcttagttcttagattttccttctgtaaaatgcatgtgatcttattttcccctccacaactttccagatgaactagactgtgaccaagaggtctataaaatcaaagcatcatggaacaggatcttgtatcagaccaaagtgtgccagtttttaaaaatgtgcatcaaaatggaagtctcagagacagagccctctggtggaaagttctagtaggttaggacagtcctgcctgcagacaccttgggctttactgagggactcaactgagaaaatgaggaatgttgcagctcatgattcttagaagaagaaagtgaagcttgtttaaaatatgatttaaaaaatctgtagaacactgtaaactacacaggctatgagggaatagcctggttgggccagcttggaaatcgggcacaggcaggaaggggcctgtctggtttgggccgtgtccacagagagcacttcttaggtcctgcctggagagaaggaatggctgggctatattttcttccagactcattatttttcttctgtttgacttttctctgaatttcccttgatttgtataaattttctcaataattagtgacagtgtctactgattgtaaaatgaagcttgaaggccaggcgcagtggctcatgcctgtaatcctagaattttgggaggccaaggtgggtggatcacaaggagttcgagaccagcctggccaaggttgtgaaaccgcgtctctactaaaaatacaaaaaaattagccgggcatggtggcacgtgcctgtagtcccagctactcaggaagctgaggcaacagaatcacttgaacctgggaggtggaggttgcagtgagccgagatcacgccactgcactccagcctgggcgagagagtgagactccgtctcaaaaaaaaaaaaaaaaaaaaaagtttgaagaacaaagacaataagaggaaatataatgagtggtcataaatgtgggctctgacagtagagtgcctgggtctgcatcctggtttcttagtcatgtgaccttaggcaagttactttaacctcgctgtacctcaggttgtccatctgtaaaatggggataataatagtgcctaccttttaaggttgatgtggggattaaatgaggtgttgctcatacaggaatgtgcctgtgcatggcaaagttcgggaaattttttataagctgttctaggcctgaaatcttcagaagatgctaatctaaattcatgaaataagcttcttacaacagaaatgctgctagtattatgcaaaattaatgttgtatatcaaacttttaactctcatccctccttattcagatatattttgttataagcaatgtttgttcccctcgttattataccacagtctacttacctgatgctatatctgcctccccagttagactgagagaacaggggatatacctaaataataataataataataataataataaataataatggagagctccttgaagatagggagcctgtaagaatcattgagggcttattttgtataccaactgctaaactagatgcttcatacattgttgtcaatactcatgacagccttgtaaagtagaaattaattcttccagttaacactaaggctgacatatgaataccttggcaaatctggaaagctgggaagacagtatttgaattcaagacttcttgtcaccaagggccatgcacttgtactctgccatgtggcccttttttacctcctgtggattctccctacctggtacttggccttaggtgtacacacacctggcactttgcttgacacataataggtggaccacaaatatctactaaatgaatatttgcatatagtaatattttaaggtactaaaagcagctcaaagtaaatatattaatatattaattccattgctatctggataaccactcaactttcctgctgaaaatgcccatttaattaaagaaggttggatagagctctctatatgcattttggacaggcaggggtttcaggtcataaacattctgatgagttaatataaaataagagaaactgtaaatttccactactaaaaatcacaaaaataacagaaacaaaagaagagataagaatttggggaattgtgctgaacaatttagtggttaaaaaaaacaactgtgcatgtttagacttaaataagcccccatccaagtgtgaggggtccagtaatttttcaaaacatatgaaagtgttaatacatttcgacaaaggaccattaaaaaagtcctgaattctgacttgagggaggaaagtaatgactaatacattctctagagacttgcagactttgggaattcataaaggaatggatgataattattaactgttgctggctgattgcccagacagttctcaacagccctgtacaagtctctgggtttgggatggatcaattctgagactggaaaatggccaaatctttgcaaatgagaaatatttttcttataagttcttattgtaggcaaataattacatagattattcatcagagaatttttaaatgctcataatctcaactctttcatttacaacttgtatttccaatagtttatgggtcatctctgcatagatgtcagaagtcacctcaagtttagcgtgtccaaaatctaactcacaggtctgtttctgacctcccaacttgctttccttgtgtttttcctatgctaatgatccaccataatcaaaataattaacatttatccagtgcctactatgtactattccctgtcctgttttacatttactcatttaaagtccataagaaacattaaatctcatctgccttctgaagaagatacaaccatgctctcttttacaaagtaggaaactgggtcacagaaaggtgaagtctttaaggctgaatcacagtagctcatcctagtaaatagaaaagccaggattcaactccaggggctgggtgcagaactgctattcttcactgcttcaccaatcagcagctacccaaggcagaaaactttttcatccttggctccttcattctccctgtcaccccagatcccctctacatctagtcagagaataggtcctgtcaattccaacttctctatatggctcctctcaggcatgtgcccttaattggcctaattctctaatacaccttccctctacatgctcactccctcagatcattgctttatcacgtgttacctgggttgctattacataaagagcaatctttctaaaatgaggatcttatcacttcacttccacactaaaatgtttttcctggggaaccacactccttagcaatctgacccatcagaccttccaggctgtctcctgcctgctccctaaggctccagccacacagaattatcatgggcccacacacccaccaaatcctcccatgcctttgcccatgttgtctgggatgcccttctctcccttctgtctacatcaagcatcagactgaatatccctcttgtgcggccttctaaaacctcccgtccaaagcgaaatatattgccctctatttatacttttacagcatttggcacacaagtacagagtagtagctttttatcacattctctgataattatatagatatggtatttcttagctctctctccaactggctaataagttgctttttgtctgagtgcctaattttgtgttttgtgtctgagtgcctcagttcctcaaaaaaaggttttttgattagttcattattcatttgaacatggaaattatgctcactagtggcaaatgccactaaccgtattccagaagctaggtgtcatgtttgcaataagatatattatcccttctacaagtcaccttttatttcaggcatttgtaaatgcccattaataaagtatggttcataaattttaccttgtaagtgcctaagaaatgagactacaagctccatttcagcaggacacaataaatattattttataatgcatct

SEQ ID NO: 917 - DNA, 6708 bp, Homo sapiens
aaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccagccgcctccccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgtgctgcaacagccagtcccacaaggggccccgagggcacccccaaggctacacccaccacaagtagaccttcgctgtcatctgacgcccccatcacatctgccccactcaagatgctggcccccagtgggtccccaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggccggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctctcacacacacacacacacacacacacacacacacagagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaaagggtgtttctggttttgccttagcaatgcatcggtctctgaggtgacactctggagtggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaatgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacattgattgtgaa

SEQ ID NO: 918 - DNA, 1673 bp, Homo sapiens
gtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccagccgcctccccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggccggggctaaggggctcccctgaatatcttctctgctcacttccaccatctaagaggaaaaggtgagttgctcatgctgattaggattgaaatgatttgtttctcttcctaggatgaaaactaaatcaattaattattc

SEQ ID NO: 919 - DNA, 864 bp, Homo sapiens
ctccgcccagaggggcctcagcttttccaccactgctttctagtcctttaactcctagaggcaaacttttgggggataagaaagcctgggaggggcctgtgccaaaaccctctctgcctggggactgggcggtgattccgcttctgcctgggctcctgccatggcccccgagaggggctgacactttagctcccggtgcaggtgagaacccgcccggaggaagaaggaaggcgcgggccggggattaggagacggaggcggactcggagccagggaaccaggggtccgggctagagctggagtcgtgagcgcgcgcccgccccgctctgggaggaccgcgagatgcccgtgctgaagcagctgggccccgcgcagcccaagaagcggcctgatcgcggcgccctgtccatctccgcgccgctcggcgacttccggcacacgctgcacgtggggcgcggcggcgacgccttcggggacacctcgttcctgagccgccacggcggcgggccgccccccgagccccgggcgccccccgcgggggccccgcgctccccgccgccgcccgccgtcccgcagtccgcagcgccctcgcctgccgacccgctgctgtccttccacctggatctggggccctccatgctggacgcggtgctgggcgtcatggacgcggcgcgcccggaggcggctgccgccaagcccgacgcggaaccccgccccgggacgcagcccccccaggcccgctgccgccccaacgcggacctcgagctgaacgacgtcatcggcctctaggttccctcattccccgcgcccttcccgcccggcaccccacttctgtatacataaacggccaaggtgtgtgcccgg

SEQ ID NO: 920 - DNA, 3009 bp, Homo sapiens
cctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagcggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaactaggagtaagtccatctcaaggtggacttctgatcattgaggatggtgagataaataggttgaaaacaatcatctgtgagtttaggagtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcaaccctggcccactctagttatgacaaccaaaaatgtctctatacattgccagatttctcctagggggcaaaatcgcctccatttgagaaccacaactctaaagtcaagatatttttctctgaagtgatttctgcttggcacgctaccctcatcatcttactcatcttaagcccgagccatggatcaactaggagcccatataaatgaggctcagtagggctgcacataatctccaaacaattctttattcagtgttttgcttgtgtttgcatgttgctatgatggacaggtccccctcctccattcttgccctctggagaagtggttcctgcagtgtagagatatgaacagggtatggtaggattggggaaaggggagagagaagcagtagatacactccttatcctccccaaattttaagctctatttctgtgccctagtcctagacacacattagactcagggagttttgtctgaagaccaggtcccactgccccctggctgaagagtctgctttaaatgggaaaacaacgtaggagcaggggtttttaggcactttcagtattctcaggtgttcttcgttctggcccttccagggtaattaggaaggcagaacaagacagatgagctcctgcctgctctgagacaagaagggtggggtctcattagctttgcaacaggaaacatcctgttttatggtagtggggtcaggaatgtaggaactggtatccattctgccaattccaccacccattcagtttgcttatccctacagaacagtgactgaggttctttttttttttttttttttttttttttcaaatttccatgtattttctgccatttttcagggtctaagattggtcatacattcccaatttactctcagttccagtcaagctggttgctctgaaagtaacccagcttgttgctctaaaatacctcagtagcctgagtgttatactagagatctaaagggttaacaggatagggtggaaaggttagagactcctagaaatctctggtcaccgtgatcttcggcctcattctaatacctgttctttggacagtctttttcctttggtgctctcttgcctttagctaccttctctaatatgtatgctaccatcactaataaagtgatgggaatgggtttgagagtcgtaatttatattaaaaagttgttggacttttaaatacattttttcaaataaaaaattaagcaaaatagttgcacagtaa

SEQ ID NO: 921 - DNA, 3181 bp, Homo sapiens
aatcgcgtcgccgccgcttccgccctcagccggccccacctctgccggctcgtactcggctcccccacctcgccgcagagctagcccgggaagcccacactggcggccacggagcagagtccctcacccccaccagctgtagctgaacgtctggatggtggagaagagcagatgatctgtactggacacacgtggagatatggccatgccacgcatgtgcaaacagaggtgtacacacaggagtgcagtgatacaggacacagataaacagaatgtacacagccttcaggaaggatctcaaggtcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagcggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaactaggagtaagtccatctcaaggtggacttctgatcattgaggatggtgagataaataggttgaaaacaatcatctgtgagtttaggagtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcaaccctggcccactctagttatgacaaccaaaaatgtctctatacattgccagatttctcctagggggcaaaatcgcctccatttgagaaccacaactctaaagtcaagatatttttctctgaagtgatttctgcttggcacgctaccctcatcatcttactcatcttaagcccgagccatggatcaactaggagcccatataaatgaggctcagtagggctgcacataatctccaaacaattctttattcagtgttttgcttgtgtttgcatgttgctatgatggacaggtccccctcctccattcttgccctctggagaagtggttcctgcagtgtagagatatgaacagggtatggtaggattggggaaaggggagagagaagcagtagatacactccttatcctccccaaattttaagctctatttctgtgccctagtcctagacacacattagactcagggagttttgtctgaagaccaggtcccactgccccctggctgaagagtctgctttaaatgggaaaacaacgtaggagcaggggtttttaggcactttcagtattctcaggtgttcttcgttctggcccttccagggtaattaggaaggcagaacaagacagatgagctcctgcctgctctgagacaagaagggtggggtctcattagctttgcaacaggaaacatcctgttttatggtagtggggtcaggaatgtaggaactggtatccattctgccaattccaccacccattcagtttgcttatccctacagaacagtgactgaggttctttttttttttttttttttttttttttcaaatttccatgtattttctgccatttttcagggtctaagattggtcatacattcccaatttactctcagttccagtcaagctggttgctctgaaagtaacccagcttgttgctctaaaatacctcagtagcctgagtgttatactagagatctaaagggttaacaggatagggtggaaaggttagagactcctagaaatctctggtcaccgtgatcttcggcctcattctaatacctgttctttggacagtctttttcctttggtgctctcttgcctttagctaccttctctaatatgtatgctaccatcactaataaagtgatgggaatgggtttgagagtcgtaatttatattaaaaagttgttggacttttaaatacattttttcaaataaaaaattaagcaaaatagttgcacagt

SEQ ID NO: 922 - DNA, 3591 bp, Homo sapiens
gagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttttttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctggttggcctttcctttaaa

SEQ ID NO: 923 - DNA, 3485 bp, Homo sapiens
gctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttttttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctggttggcctttccttt

SEQ ID NO: 924 - DNA, 4352 bp, Homo sapiens
gcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccagtgagtactcagagctggggtctggacctgacggccagacatggccaggccaataatagtaaatatatgtatatatatataattttttaatggtgaacttattgggaaaggcaaaattactcagctaagtgtagtttctgcacttggaatgtaagttttaggttcttttccttattaagaactttaaatactttaaaacatctggttggggaggattctgatgacaagatgcttcttatgtgtcctttaaacaagagtgaaatcattattttgagtattgaggccgagcatggtggctcacacctgtaatcccagcactttgggaggcctaggtgggctgatcacctgaggccaggaattggagactagcctggccaacatggtgaaaccccatctctactaaaaatacaaaaattagctgggcatggtggcgcatgcctgtaatcgcagctactcaggaggctgaggcacgagaattgcttgaacctgggaggcaggggttgcagtcagctgagaatgcgccactgcgctccagcctgggtgacagagcaagaccctgtctcaaaaaagtactgatactaaagataatctcttgggtagtaattttacagttaagacttcattgtttataaacttttcaaattaattaaaaagactactttgaaaaaggataaaccctgaaaatgtagaaataatttcaagtttttttttgttttatagggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttttttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaa

SEQ ID NO: 925 - DNA, 2351 bp, Homo sapiens
gtacccctccaggtgcctccttgagggcagtgaccccaagcgccagacgcttgagaagcttgggaggatgacgtagggtggagcctgcgacctaatcctcccatcacaaggggcacgcgaaaagcaacccatctgcagggcgctctggagcctctctagccgcctagagcctgcgagagcaaaggcggctggagacttagggggcggggagtaaagtgaggactgcaccaaatctcctggcctcttggggacgcaaagactcaggaggaggaattttatcgccttatctttgcctccaggaagtcataccctccacaaaaggaaagcagagatttttattcggtcttctcttttaccctttccttttccgtttctaactttgcttgacgttaatggttccttcctccctctcctcctctgcgctttggtacgagccaagggagaggggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 926 - DNA, 2075 bp, Homo sapiens
atgctcccgacggctgcgggcttcagcatctggggccagcccggggcagcaagggaggcgccgcgatgccagacgaaaatatcttcctgttcgtgcccaacctcatcggtgagtgctgcccacggccccgggccgaacgagagggcgaggggccttggcgggctccctgatcctgccctgtctccccgcgtcccgttccaaggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacaggtctgctgcgattctgggggcctgggccacttggagacattacagtggggtgggctgagcctagacggaagggtgtctgggatggcactaggcatcctggaagggctcctttttagctctgctttgtagaaagaccccaggcaaacctgcctctctttaaagcttcagtcatgtttacagttgcattaagcaattcttaggactcttctggctgggtattctaggattccatataggtgacagcttataggaaggggcatgggagctttcaaatgtggcatttgaatcctgactctgcccccaaataggtaactgtggctttcggcaggatactggtccttagccgtgcccagttttccatctgtacaataggtgttaacatgaggattggatgcatggtagtggtcatgaaaccttgtgggttcccctgttttctccccaagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatg

SEQ ID NO: 927 - DNA, 3853 bp, Homo sapiens
ggtgcttcgtagagctgccgccgtcgccgctgccgctgccgccacagccgccgctgcagccggagcatccgggagccgccactgccgccgccgctgccgctgctaccgccactagcgctgcttccactgcttctacctcccctcccaggaccccgagacaccccgggcgcgagcggcagtgctgcttgcttgctcctcctctcccccagcccttcccctccgtgacctacccactccttgcagccctcgcccgcaccttctccaacaccccggcatccctgcaccacctgctcgggcagccccggcgggctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccctcgttccttccccagccctttagagaagggaccatgatttggaaacgcagcgccgttctccgcttctacagtgtctgcgggctcctgctacaagcggctgcttcaaagaataaagttaaaggcagccaagggcagtttccactaacacagaatgtaaccgttgttgaaggtggaactgcaattttgacctgcagggttgatcaaaatgataacacctccctccagtggtcaaatccagctcaacagactctgtactttgacgacaagaaagctttaagggacaataggatcgagctggttcgcgcttcctggcatgaattgagtattagtgtcagtgatgtgtctctctctgatgaaggacagtacacctgttctttatttacaatgcctgtcaaaacttccaaggcatatctcaccgttctgggtgttcctgaaaagcctcagattagtggattctcatcaccagttatggagggtgacttgatgcagctgacttgcaaaacatctggtagtaaacctgcagctgatataagatggttcaaaaatgacaaagagattaaagatgtaaaatatttaaaagaagaggatgcaaatcgcaagacattcactgtcagcagcacactggacttccgagtggaccggagtgatgatggagtggcggtcatctgcagagtagatcacgaatccctcaatgccacccctcaggtagccatgcaggtgctagaaatacactatacaccatcagttaagattataccatcgactccttttccacaagaaggacagcctttaattttgacttgtgaatccaaaggaaaaccactgccagaacctgttttgtggacaaaggatggcggagaattaccagatcctgaccgaatggttgtgagtggtagggagctaaacattcttttcctgaacaaaacggataatggtacatatcgatgtgaagccacaaacaccattggccaaagcagtgcggaatatgttctcattgtgcatgatcctaatgctttggctggccagaatggccctgaccatgctctcataggaggaatagtggctgtagttgtatttgtcacgctgtgttctatctttctgcttggtcgatatctggcaaggcataaaggaacgtatttaacaaatgaagctaaaggagctgaagatgcaccagatgctgatacagccattatcaatgctgaaggcagccaagtcaatgctgaagagaaaaaagagtatttcatttaagatgcaggccaagattctgagttttactaccaggctgaatgctggagaaaactggctatcatctttcagaagtcatttctaccatcgtctgctacccttattaactcccatactgtactgctatcagtagccagtgtataccaacaatcagctgttgaaagcatcattctttaattactgtaccatccataatgcaggacatttcttactgcctaaatttcacaccattgctcttttaacatacagtgcttgaatatacagccttaacaatgttaatcatctccttggatcattatattgagtggtttttatacattaaaaaatgtatgcagagtttttttcccccattttttcccctttaagtcatagaccttatcagtttgccattggacagctttcacaagtaacaggattagggaaggacataatgtatttaagaataagtgaaggttagaggtttacaattaatgttttctacatgtctgtcttcaaagacaacatgctttggaaacatatgtcctagaaaacataaaattaaaaaaaaacactatagtgtagtttttggaatgttggagattatactggtaaagctgtatcgatttgctattgaaatatagtatttgatacaggagccatgtgtacgaattgcaatcatgacatggtattttctataattatagagatcttactattaggatattgtagcttcatttaccaataaattattccaaatgatttactgcttttggaatcacaaatatttaattcatttctctaatttgattctataatttatttgcttcataaagattcacctgcctaaacaatattgaagtatccatagggcacaattttcagacattttagtatctgtatatagtgcatataataaatccaattaaacattatttgatacatatttaacttttttggctgtatgtaattcagtcataagtaagcattttctaacgtccattatatccctttaggtattacttaaaccaatattataagtagataacatgtattagtatttttgtctgtatgtcctagcactgttcaacaacaaatttttctagttcttgttaatttttatttgttatacaatggaagcacaatgttataaggaaaggtaattttaagctaacaaccagtgcacagcctcaggttttaaattacaaccacagttgaataataacctaaaaataaattttagtttgctaaaaatttacaaattttcattttgcagttccagagctgcttacctatgttggtttgccaaaaagaagtgtttaagatatgttttctgtataaatgaactaattctttatattaaattcctgtctatgcattttgtgaggtacaaactgatgaaacagtgagtgatagagaatttctgccatgcttttaactccaaagtgaaagtctctttctctggattattttaaaattttggcgtgtttaaccattaagaaatgctgtattcttaaatatgaaacagttaatctaaagtcttattatttcttctagtaaaataaaatattgttagattagttctcattaaatttattatatgctaaagaataaaactccagttagatttaaaaaaatcccatttacaagcattgcacctttaagaagaaaacaaatatgacagtatggtagctatacttgtgatgtctgacgcatgatggcctatggttttaaaaatagtattgtggaatatatttttgggtaataagaatggttgagtgcaacatcatgtattaatatcaaatgaaagacaagggtgctgtatctttgattatttatcaaaaaagtataaatcttttaaggaaaatgttagaattttaaagtttttttttgattgttgaagcatttatcttgttgatttcttacaaaagaaaaaggacgatgtcagtcaagcagcactttttcagaatatacagaacataaataatatgatgtggttgagtgttaacataataaatcatatacagtatgacatttt

SEQ ID NO: 928 - DNA, 1314 bp, Homo sapiens
atgtttgttctcttcttgtgcaacctttccttggtaccagcggctgcttcaaagaataaagttaaaggcagccaagggcagtttccactaacacagaatgtaaccgttgttgaaggtggaactgcaattttgacctgcagggttgatcaaaatgataacacctccctccagtggtcaaatccagctcaacagactctgtactttgacgacaagaaagctttaagggacaataggatcgagctggttcgcgcttcctggcatgaattgagtattagtgtcagtgatgtgtctctctctgatgaaggacagtacacctgttctttatttacaatgcctgtcaaaacttccaaggcatatctcaccgttctgggtgttcctgaaaagcctcagattagtggattctcatcaccagttatggagggtgacttgatgcagctgacttgcaaaacatctggtagtaaacctgcagctgatataagatggttcaaaaatgacaaagagattaaagatgtaaaatatttaaaagaagaggatgcaaatcgcaagacattcactgtcagcagcacactggacttccgagtggaccggagtgatgatggagtggcggtcatctgcagagtagatcacgaatccctcaatgccacccctcaggtagccatgcaggtgctagaaatacactatacaccatcagttaagattataccatcgactccttttccacaagaaggacagcctttaattttgacttgtgaatccaaaggaaaaccactgccagaacctgttttgtggacaaaggatggcggagaattaccagatcctgaccgaatggttgtgagtggtagggagctaaacattcttttcctgaacaaaacggataatggtacatatcgatgtgaagccacaaacaccattggccaaagcagtgcggaatatgttctcattgtgcatgatgttcccaacactttgcttcccactactatcatcccctcccttaccactgcaacagtcacaaccactgtagccataacaaccagcccaaccacatctgcaacaaccagcagcatcagagatcctaatgctttggctggccagaatggccctgaccatgctctcataggaggaatagtggctgtagttgtatttgtcacgctgtgttctatctttctgcttggtcgatatctggcaaggcataaaggaacgtatttaacaaatgaagctaaaggagctgaagatgcaccagatgctgatacagccattatcaatgctgaaggcagccaagtcaatgctgaagagaaaaaagagtatttcatttaa

SEQ ID NO: 929 - DNA, 1422 bp, Homo sapiens
gccccgctcaccagcatctacttgccccctcgttccttccccagccctttagagaagggaccatgatttggaaacgcagcgccgttctccgcttctacagtgtctgcgggctcctgctacaaggcagccaagggcagtttccactaacacagaatgtaaccgttgttgaaggtggaactgcaattttgacctgcagggttgatcaaaatgataacacctccctccagtggtcaaatccagctcaacagactctgtactttgacgacaagaaagctttaagggacaataggatcgagctggttcgcgcttcctggcatgaattgagtattagtgtcagtgatgtgtctctctctgatgaaggacagtacacctgttctttatttacaatgcctgtcaaaacttccaaggcatatctcaccgttctgggtgttcctgaaaagcctcagattagtggattctcatcaccagttatggagggtgacttgatgcagctgacttgcaaaacatctggtagtaaacctgcagctgatataagatggttcaaaaatgacaaagagattaaagatgtaaaatatttaaaagaagaggatgcaaatcgcaagacattcactgtcagcagcacactggacttccgagtggaccggagtgatgatggagtggcggtcatctgcagagtagatcacgaatccctcaatgccacccctcaggtagccatgcaggtgctagaaatacactatacaccatcagttaagattataccatcgactccttttccacaagaaggacagcctttaattttgacttgtgaatccaaaggaaaaccactgccagaacctgttttgtggacaaaggatggcggagaattaccagatcctgaccgaatggttgtgagtggtagggagctaaacattcttttcctgaacaaaacggataatggtacatatcgatgtgaagccacaaacaccattggccaaagcagtgcggaatatgttctcattgtgcatgatgttcccaacactttgcttcccactactatcatcccctcccttaccactgcaacagtcacaaccactgtagccataacaaccagcccaaccacatctgcaacaaccagcagcatcagagatcctaatgctttggctggccagaatggccctgaccatgctctcataggaggaatagtggctgtagttgtatttgtcacgctgtgttctatctttctgcttggtcgatatctggcaaggcataaaggaacgtatttaacaaatgaagctaaaggagctgaagatgcaccagatgctgatacagccattatcaatgctgaaggcagccaagtcaatgctgaagagaaaaaagagtatttcatttaagatgcaggccaagattctgagttttactaccaggctgaatgctggagaaaac

SEQ ID NO: 930 - DNA, 2546 bp, Homo sapiens
agcgccggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacggctactggcaggagcaggatttggagctgggaactctggctccactcgacgaggccatcagctccacagtctggagcagccctgacatgctggccagtcaagacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttccttggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgca

SEQ ID NO: 931 - DNA, 3745 bp, Homo sapiens
agcgccggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttccttggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgcagtgagctgtttcctgcccaaactaagggaataatgtgaactgtgtgcatgtgtgtggtgtgtatgcatgtgtgcatgtgtgtgtgtgtgtgtgcatgtgtgtgagtgagtgagaggcagagcgaggaactgaggaggagggctaagagccaggggtcctgggcaagtggacagggctgtgggacatgttggggaggctttgggaatggggtattcctagtcagggttcacacctcacctgggatgttgttccatgctggtatttcctctgccacccccaatgcccatcggtcttggagaaaggagtccccgggtgtgtgtttgcccagctgtccattctatctctcccttaaacacagagcattcagcccttccctggatttccctcctctgagccatggagtcagtgccacagcctttgctatgcacctctcaggcctctccttggcgttgaccctggaaagacctaccaccacctattttttcccatagtctgtacccagtgagttgaaggctgggtccccacccttccttttgatttcctgtcttccttctcgtggccccagctggttgctgtggagatgaggttcctggtcctccctgtcctggctggactgccccgcctcagatccaggatgcccttggcatcgctcccaccctcccccagcttttcctccctggtctgacaatgggcatgcaaaaaggggcagctgcaatctagcaggcctgcccacccccttcagttcaggtaatacagttgtgaatcttccagccgctggttagggccttgggcaccacaggcagcccctcacctaagccggggcctactcctcttacaacagcaagagagccctggggccccaggcctgttgagcttcttgtctcccagcacccgcttttgggaaaatgacttttcctcttcaagctgaaccactctgtccatattacacagaagccatatttgtacgggggggtgggagggagaggggctgttgtgctgtgtgtgtctgtccaggggtgggggggtgggggaagggagcagggaggggaccgtgtatctttataatctttctaactctcctgtgctaatctcagaggggtcaccctcaatatatctggattatccgtgtcattcagctgcctcctttctggtcctcttgctgctgctgggatgtgtgtatgtgagggtcttcttcccataccccttgcacctggtgcctggtgcctcaaaaggtggtgtgtcccttgccaggccactctcaagaatatctatgtacagcaacaatataactctacaaggga

SEQ ID NO: 932 - DNA, 711 bp, Homo sapiens
aagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatgacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccagga

SEQ ID NO: 933 - DNA, 4108 bp, Homo sapiens
cagagggctgctggctggctaagtccctcccgctcccggctctcgcctcactaggagcggctctcggtgcagcgggacagggcgaagcggcctgcgcccacggagcgcgcgacactgcccggaagggaccaccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctaggaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgacttt

SEQ ID NO: 934 - DNA, 3438 bp, Homo sapiens
gtgcgaggcccagccgggcgccccgctggcgggtcgcgcgcgcgcccgcgcactcttcctgccctcgaggcgcgccgcgccccctcccccacccgctcgcgtaggctaccgctcgctgcgcgttttgtcccgcgtctcgccccgtccgtctcctgactggccgctcttgtccttcctcccgctttttcttctctctccttgcggtctgaagatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcag

SEQ ID NO: 935 - DNA, 3498 bp, Homo sapiens
actaggagcggctctcggtgcagcgggacagggcgaagcggcctgcgcccacggagcgcgcgacactgcccggaagggaccaccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagagcaggtaccttgtctgtcttctctgctgtatctattcccaacgcttgatgatggtgcctggcacatagtaggcactcaataaatatttgttgaatg

SEQ ID NO: 936 - DNA, 6666 bp, Homo sapiens
gcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccttggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctttatattctgtaacatgaaacttacctaatcttcaaatgttagcttcattttttacctttgaaatacttaatctttctgaataaatataatgtgtctataaaataatgagactgattctggtgtctttagtcattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttaatcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatcttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaggagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctg

SEQ ID NO: 937 - DNA, 1408 bp, Homo sapiens
gcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagaaagctcttcactgactttgttaatgatgttaaagattatcttagaaacatgaaggaatatgaagtagataatgatggagtatttgagaagttggatgaatatatatatagacacttctttggtcacactttttcccctccatatggacccagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactga

SEQ ID NO: 938 - DNA, 2580 bp, Homo sapiens
agccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccttggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttg

SEQ ID NO: 939 - DNA, 1277 bp, Homo sapiens
agaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctga

SEQ ID NO: 940 - DNA, 929 bp, Homo sapiens
agaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaagggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctg

SEQ ID NO: 941 - DNA, 1036 bp, Homo sapiens
agtatttccaggaggctgtgagggggaggtccaacgcagtccagctgacaaggatggaatacgccatgaagtcccttagccttctctaccccaagtccctctccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctga

SEQ ID NO: 942 - DNA, 1123 bp, Homo sapiens
agaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctctaccccaagtccctctccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctga

SEQ ID NO: 943 - DNA, 877 bp, Homo sapiens
gtccaacgcagtccagctgacaaggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaagactaggaaccctgaagccaggagccaagaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccc

SEQ ID NO: 944 - DNA, 2472 bp, Homo sapiens
cacactgcctcggttcggcaagtgggtcagttggctggggctcacttggcaacgggacgcgggaacgaggggcgcggacgcaggcccgggaggacgcggcggcgggaacctgggggcgcagggctagggcagcgggcccgacccgcacggctttcctggaaagcgctgcccctcgccgcggcgatgccctcgctgtggagagaaatcctcttggagtcgctgctgggatgtgtttcttggtctctctaccatgacctgggaccgatgatctattactttcctttgcaaacactagaactcactgggcttgaaggttttagtatagcatttctttctccaatattcctaacaattactcctttctggaaattggttaacaagaagtggatgctaaccctgctgaggataatcactattggcagcatagcctccttccaggctccaaatgccaaacttcgactgatggttcttgcgcttggggtgtcttcctcactgatagtgcaagctgtgacttggtggtcaggaagtcatttgcaaaggtacctcagaatttggggattcattttaggacagattgttcttgttgttctacgcatatggtatacttcactaaacccaatctggagttatcagatgtccaacaaagtgatactgacattaagtgccatagccacacttgatcgtattggcacagatggtgactgcagtaaacctgaagaaaagaagactggtgaggtagccacggggatggcctctagacccaactggctgctggcaggggctgcttttggtagccttgtgttcctcacccactgggtttttggagaagtctctcttgtttccagatgggcagtgagtgggcatccacatccagggccagatcctaacccatttggaggtgcagtactgctgtgcttggcaagtggattgatgcttccatcttgtttgtggtttcgtggtactggtttgatctggtgggttacaggaacagcttcagctgcggggctcctttacctgcacacatgggcagctgctgtgtctggctgtgtcttcgccatctttactgcatccatgtggccccaaacacttggacaccttattaactcagggacaaaccctgggaaaaccatgaccattgccatgatattttatcttctagaaatatttttctgtgcctggtgcacagcttttaagtttgtcccaggaggtgtctacgctagagaaagatcagatgtgcttttggggacaatgatgttaattatcgggctgaatatgctatttggtcctaagaaaaaccttgacttgcttcttcaaacaaaaaacagttctaaagtgcttttcagaaagagtgaaaaatacatgaaactttttctgtggctgcttgttggtgtgggattgttgggattaggactacggcataaagcctatgagagaaaactgggcaaagtggcaccaaccaaagaggtctctgctgccatctggcctttcaggtttggatatgacaatgaagggtggtctagtctagaaagatcagctcacctgctcaatgaaacaggtgcagatttcataacaattttggagagtgatgcttctaagccctatatggggaacaatgacttaaccatgtggctaggggaaaagttgggtttctatacagactttggtccaagcacaaggtatcacacttgggggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgaagatgacctcgacaggaaactgcaggctattgctgtttcaaaactactgaaaagtagctctaatcaagtgatatttctgggatatatcacttcagcacctggctccagagattatctacagctcactgaacatggcaatgtgaaggatatcgacagcactgatcatgacagatggtgtgaatacattatgtatcgagggctgatcaggttgggttatgcaagaatctcccatgctgaactgagtgattcagaaattcagatggcaaaatttaggatccctgatgaccccactaattatagagacaaccagaaagtggtcatagaccacagagaagtttctgagaaaattcattttaatcccagatttggatcctacaaagaaggacacaattatgaaaacaaccatcattttcatatgaatactcccaaatactttttatgaaacatttaaaacaagaagttattggctgggaaaatctaagaaaaaaagtatgtaagataaaaagaagagattaatgaaagtgggaaaatacacatgaagaacctcaacttaaaaaacacatggtatctatgcagtgggaaattacctccatttgtaaactatgttgcttaataaaaacatttctctaaa

SEQ ID NO: 945 - DNA, 2432 bp, Homo sapiens
atgttgtgggaggtccctgaggccgctgaggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaataaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatatctgtattttactactgttaagtttctttgtatgaactgtgttgttagtactcagatagtttagctttgtatttataatagagcttttatataaagttttaaaaattgaatgtgtgatatgtgttctttgaaggttttttaatttaacatttatagtcactttttagtgcacacattttccagactttcgttaataaaatatttattttattagaattttaaagtttggtaaatttgtttttattcctagtatctgttaaccctcaagagtggatttcttaaatcttccctttataattttactagtttctgaaacaaaaattgaaatacaattagcaatagagtggcacatttttccattacctaacatttcatcaattttgacattctatattttaatacaagctgactcaatataagcctaattccttttttaagagtcctgtctttgagtttagaaggaataagtattgtgcagatagacccatttatccttgtgtattatgtttcttaacttggtatcattgtaagtatgaaagttaattttcttctgaatatttccttaaacaaattgaatgaatacaatttgaattttctaacttcttgactgagagatttaaattttggaattttgatttgttaaggtaattatcactcaattacatgtcacagtgatgaaaatagaaaactgtaagccacagaaataatttaagtctatgttttacctatatgaaggaacagtctgtgattcaccaggaaatagtagagacacagtttccaagtactggtgggctcttctgccttgtagaagtgtatgttagggggaaacaagtggttatggagatcgatcatagaaaaaaatagtacctatatggatccttcactcatatctagtactcggtgttatgggctctcccaggaacggaattgagttgtctatttcagcaatctttctttagaattcttgttttaaatttttaagtttaaagtgtagtatcatttgaggcgctttaaatgttgtgagccttttaagagtattacattaagggttgtccactagaaatttaacacaaaatcagtagggaatactatagcagtagtgacatttcaaacagttatctaggaagcaagtgtatattaagtcattcttgtattgctacgaagaaatacccaagactgcatattttataaagaaaagaagcttaattggcttacggttctgcaggctttacaggaagcatggtgcttctgcttttggggaggcctcaggaagcttacagtcatggtagaaggcaaagggggagcaggcacatcacatggtgaaaaccagagtgaacaagtgagagaagtgccaagtactttgaaaccaccagatctcatgagaactcactattgtgaggacatctaatcacctcccaccagacctcacctccagtactggggattacaattcaacatgatatttgagtggggacagatatacaaactatatcagcaggttaactagagtaaaacttaattttgaatacaaattcaatggtcacagtcattatattcagggcaacagaccttgaaattaaaaaatttttgtcgcacactgatgagttccctctgtcttgatcatgaaatatattgatttccaggaaagtgaaaaataaaacagtaaaagtaaa

SEQ ID NO: 946 - DNA, 4450 bp, Homo sapiens
ccgcctcccgccgcccgccgcccgccgcccgggccactgcaggggccgctaacggtccggcgcccctcggcgtccgcgcgcccccagcctggcggacgagcccggcggcggagatgggggcgacgggggcggcggagccgctgcaatccgtgctgtgggtgaagcagcagcgctgcgccgtgagcctggagcccgcgcgggctctgctgcgctggtggcggagcccggggcccggagccggcgcccccggcgcggatgcctgctctgtgcctgtatctgagatcatcgccgttgaggaaacagacgttcacgggaaacatcaaggcagtggaaaatggcagaaaatggaaaagccttacgcttttacagttcactgtgtaaagagagcacgacggcaccgctggaagtgggcgcaggtgactttctggtgtccagaggagcagctgtgtcacttgtggctgcagaccctgcgggagatgctggagaagctgacgtccagaccaaagcatttactggtatttatcaacccgtttggaggaaaaggacaaggcaagcggatatatgaaagaaaagtggcaccactgttcaccttagcctccatcaccactgacatcatcgttactgaacatgctaatcaggccaaggagactctgtatgagattaacatagacaaatacgacggcatcgtctgtgtcggcggagatggtatgttcagcgaggtgctgcacggtctgattgggaggacgcagaggagcgccggggtcgaccagaaccacccccgggctgtgctggtccccagtagcctccggattggaatcattcccgcagggtcaacggactgcgtgtgttactccaccgtgggcaccagcgacgcagaaacctcggcgctgcatatcgttgttggggactcgctggccatggatgtgtcctcagtccaccacaacagcacactccttcgctactccgtgtccctgctgggctacggcttctacggggacatcatcaaggacagtgagaagaaacggtggttgggtcttgccagatacgacttttcaggtttaaagaccttcctctcccaccactgctatgaagggacagtgtccttcctccctgcacaacacacggtgggatctccaagggataggaagccctgccgggcaggatgctttgtttgcaggcaaagcaagcagcagctggaggaggagcagaagaaagcactgtatggtttggaagctgcggaggacgtggaggagtggcaagtcgtctgtgggaagtttctggccatcaatgccacaaacatgtcctgtgcttgtcgccggagccccaggggcctctccccggctgcccacttgggagacgggtcttctgacctcatcctcatccggaaatgctccaggttcaattttctgagatttctcatcaggcacaccaaccagcaggaccagtttgacttcacttttgttgaagtttatcgcgtcaagaaattccagtttacgtcgaagcacatggaggatgaggacagcgacctcaaggagggggggaagaagcgctttgggcacatttgcagcagccacccctcctgctgctgcaccgtctccaacagctcctggaactgcgacggggaggtcctgcacagccctgccatcgaggtcagagtccactgccagctggttcgactctttgcacgaggaattgaagagaatccgaagccagactcacacagctgagaagccggcgtcctgctcacaaactgggaaagtgtgaaaactatttaagataattattacagaccaattatgttgatatatacatttaaatgtagaaatttatttttgatagttaaatcttgattttagaagaaaacccttttgtcaacaattttgtgtacatatttggcattttcagttctgtacgcatctgcgggttgcagcccacgccgcttactctcagcggatgcagctgctcacttgggggcactggcctcttaggttttaacgatgtcaacagtgtagtttagaaaatggcccgttagtggctctattgcaataatgttagggacattatatgatttccacgcaggtcacaccatctgggcctgaggtagcagtgggtcactttgatccactttgcaggacttattctgtaacggtttgtggccaagttttgggaagtggttgattctctttgccttcatttcaccttcctcttcgtttacggttaggacatcgctgcttgatccttacaatactgtgcaactgcaatgcaacgtggccctgcttcaggtgatccgcgggaggggcctccacgccagcgccgggaaggctgctggggcctccacacctgcctcatcacggcggcgaggctacgacaatccggctgggagcatgaccttggcgtctgttctgggagcacggatgataagctctggaagctggcagtgtgtaaagcactggcaagtttgttactgttaaaatgtcaaataccaatgctttatatcgacgcgaagtgcttaacacagccgggcttgggggcagtcaggaggaagctggccatccgtggaggaggggccggtcctggactcccgcaggactcctctgaggcagggcctgaagtctgtacacgtggtccagatttgtccttgtcttttcttcacactgagttctctatatttattgaacatcttgtccttttaagccagagtagtgtaaactgcgtctcggatgtctgtcttttgcctcgaagccacgatggatcgctggtttcctctgcagcgcgagggctccggcgaccagaggattcttcccggaaggcattcctgccgcgctccccggggcacccctcaattgtgtactacgtccttgtttagtgtgtatccgtgcccacgtagatgatgtctgtaacgtagttttgtttgaaatatgagaatatgcggcttaaactttgatctgtaaggagcggggccgtggccgtttggagcacgctgtagacaccgttcctcatgctgccgggtgggttttgcagaagctcccttagtgatttcatgtttaacaggcagcatccattttcagaatttcctggcattgatttatattttgaagcatacaggaaacttctcgtttcctcgtttagccccacccagatcaggtgaaagggcagctttaatggtggtttttatggaccacattatcagagagcactgtgcaagccaaatggttcaataatgaatgaaaattctgggtgtaaagagtaaatatgccctggctctttctaccaatgtttgctcctggttggaaagaaaccaaagatttaagacgggctgctcttccagactggctgtgcctgcctgtgcccagcaacctgtgcagccggcagtgtgcctggtgtcacgccaggaggctgtggctgctgtgggccctctggaattgtgctcctcacaaagtttccccaaaaggttcttctaagcctttattgtccctggtaaatgtttcccggctgggcgcggtggctcacgcctgtaatcccagcactttgggaggccgaggcgggtggatcacctaaggtcaggagtttgagatcagcctgcccaacatggtgaaacctcgtctctactaaaaatacacaacttagccagtcttgttggcgcacgcctgtaatctcagctactagggatgctgaggcaggagaatcgcttgaacccaagaaagaggtggaggttgcggtgagccaagattgcgccactgcactccagcctgggcaaacagagggagactccatcgccccccccaacaaaaaaaaaagtttcccatacactggcctgccccaaaacccactaacaattttagcaaaacagtccaggccaaagaggaagcatttcatgttcaataagaaacccagccattccgcatggctggttcctgagtggctctggtgatactctccagccacctgctgacattcagaatctcagacctcgggactgctgttgcggtaccgtgtgtctgacacctgccagcagccctttgctatctgcgcgcaggatgggggtgactgcccagacattcccgctagataggctctgatttccggggcagcctttcagatgcggcagacatacaacacctgtactttagagttttaagggaaaaaaaatcagaagtgctggttagatagtaaaaacttaggataacttagaaaggctagttttagcttcctttgtggctccctggtgcaaaacaattagcagttatgcaatggacctgattctagtttattctaattaagaagtgaggccgagtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcag

SEQ ID NO: 947 - DNA, 1755 bp, Homo sapiens
gtccggcgcccctcggcgtccgcgcgcccccagcctggcggacgagcccggcggcggagatgggggcgacgggggcggcggagccgctgcaatccgtgctgtgggtgaagcagcagcgctgcgccgtgagcctggagcccgcgcgggctctgctgcgctggtggcggagcccggggcccggagccggcgcccccggcgcggatgcctgctctgtgcctgtatctgagatcatcgccgttgaggaaacagacgttcacgggaaacatcaaggcagtggaaaatggcagaaaatggaaaagccttacgcttttacagttcactgtgtaaagagagcacgacggcaccgctggaagtgggcgcaggtgactttctggtgtccagaggagcagctgtgtcacttgtggctgcagaccctgcgggagatgctggagaagctgacgtccagaccaaagcatttactggtatttatcaacccgtttggaggaaaaggacaaggcaagcggatatatgaaagaaaagtggcaccactgttcaccttagcctccatcaccactgacatcatcgcatcgtctgtgtcggcggagatggtatgttcagcgaggtgctgcacggtctgattgggaggacgcagaggagcgccggggtcgaccagaaccacccccgggctgtgctggtccccagtagcctccggattggaatcattcccgcagggtcaacggactgcgtgtgttactccaccgtgggcaccagcgacgcagaaacctcggcgctgcatatcgttgttggggactcgctggccatggatgtgtcctcagtccaccacaacagcacactccttcgctactccgtgtccctgctgggctacggcttctacggggacatcatcaaggacagtgagaagaaacggtggttgggtcttgccagatacgacttttcaggtttaaagaccttcctctcccaccactgctatgaagggacagtgtccttcctccctgcacaacacacggtgggatctccaagggataggaagccctgccgggcaggatgctttgtttgcaggcaaagcaagcagcagctggaggaggagcagaagaaagcactgtatggtttggaagctgcggaggacgtggaggagtggcaagtcgtctgtgggaagtttctggccatcaatgccacaaacatgtcctgtgcttgtcgccggagccccaggggcctctccccggctgcccacttgggagacgggtcttctgacctcatcctcatccggaaatgctccaggttcaattttctgagatttctcatcaggcacaccaaccagcaggaccagtttgacttcacttttgttgaagtttatcgcgtcaagaaattccagtttacgtcgaagcacatggaggatgaggacagcgacctcaaggagggggggaagaagcgctttgggcacatttgcagcagccacccctcctgctgctgcaccgtctccaacagctcctggaactgcgacggggaggtcctgcacagccctgccatcgaggtcagagtccactgccagctggttcgactctttgcacgaggaattgaagagaatccgaagccagactcacacagctgagaagccggcgtcctgctcacaaactgggaaagtgtgaaaactatttaagataattattacagaccaattatgttgatatatacatttaaatgtagaaatttatttttgatagttaaatcttgattttagaagaaaacccttttgtc

SEQ ID NO: 948 - DNA, 2558 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgccctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagaagccactgaggaacggcctggtgaaggacaagcgcttctgaacccctcggccccgcccccgtggacccggccccaccccgaataccccggccacgctccccgtccttggccgcccctccaccccctccaactctgctcctctagggccgccgccacctcccctgggaccccgccccctcatcctgcctccagttcccggccacgccccccaggacccctgcccctccggggacaccggccccgccctcagcccactggtcccgggccgccgcggaccctgcgcactctctggtcatcgcctgggaggaagatgccaccgccgcagcaaggtccctgcggccaccacctcctcctcctcctggccctgctgctgccctcgctgcccctgacccgcgcccccgtgcccccaggcccagccgccgccctgctccaggctctaggactgcgcgatgagccccagggtgcccccaggctccggccggttcccccggtcatgtggcgcctgtttcgacgccgggacccccaggagaccaggtctggctcgcggcggacgtccccaggggtcaccctgcaaccgtgccacgtggaggagctgggggtcgccggaaacatcgtgcgccacatcccggaccgcggtgcgcccacccgggcctcggagcctgcctcggccgcggggcattgccctgagtggacagtcgtcttcgacctgtcggctgtggaacccgctgagcgcccgagccgggcccgcctggagctgcgtttcgcggcggcggcggcggcagccccggagggcggctgggagctgagcgtggcgcaagcgggccagggcgcgggcgcggaccccgggccggtgctgctccgccagttggtgcccgccctggggccgccagtgcgcgcggagctgctgggcgccgcttgggctcgcaacgcctcatggccgcgcagcctccgcctggcgctggcgctacgcccccgggcccctgccgcctgcgcgcgcctggccgaggcctcgctgctgctggtgaccctcgacccgcgcctgtgccaccccctggcccggccgcggcgcgacgccgaacccgtgttgggcggcggccccgggggcgcttgtcgcgcgcggcggctgtacgtgagcttccgcgaggtgggctggcaccgctgggtcatcgcgccgcgcggcttcctggccaactactgccagggtcagtgcgcgctgcccgtcgcgctgtcggggtccggggggccgccggcgctcaaccacgctgtgctgcgcgcgctcatgcacgcggccgccccgggagccgccgacctgccctgctgcgtgcccgcgcgcctgtcgcccatctccgtgctcttctttgacaacagcgacaacgtggtgctgcggcagtatgaggacatggtggtggacgagtgcggctgccgctaacccggggcgggcagggacgcgggcccaacaataaatgccgcgtgg

SEQ ID NO: 949 - DNA, 2099 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgccctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtgagtgtggaggggcccgcaccccgcgttccctcctttagtgtcacccgtccaagcgtgttcgtgggcaggcccccaagacccagcagcagatgaggccgacgcggatgctgccccccaagcctactccaaaacagagactgcaataaaggcgtggacgatgtggccagtaccctgaaggacaggacagtgaggaaggggagggagaggctggggaggggcaggcagggcgacaggcagggtctcagcggtagggacactgagggccaggcctagtggctggtgtggcgggagtggcgagccagggccctgtgggtggtgaggagtagttgctggccagcctggatgacgacctctgacccatgtcgccactggagctggtggcagtggggctggggaggaaggaacgccaagggccacagagagaacccaggctccatctgggccgagacatcctggcctctgagtttgacaggggagcccactgcccggccaaacaggagctggggctgggagctcagactcagtccagcccaggtgggagtcctggggaaggagatagcccacgagcctcaccagccctgggtgacagccagatggtgtccgaagccccaggcctggggcaggcagggggtgtctgggccagggatgaacggaggccaaactgggtaacaagcagagtcgggtgtgcagtgtctcataggcaacgtgaggagtgtttgagcaggagccggggcaggaggttgtggaaggccctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacgactc

SEQ ID NO: 950 - DNA, 1897 bp, Homo sapiens
gagaatgtttcattgagcctacgcctcctgaatgcgggagggccacgggatggtcccaagactgtgccaaggcgtgccaggcctcgggtccttgagaaggagcgagggctccaagaacgcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtgagtgtggaggggcccgcaccccgcgttccctcctttagtgtcacccgtccaagcgtgttcgtgggcaggcccccaagacccagcagcagatgaggccgacgcggatgctgccccccaagcctactccaaaacagagactgcaataaaggcgtggacgatgtggccagtaccctgaaggacaggacagtgaggaaggggagggagaggctggggaggggcaggcagggcgacaggcagggtctcagcggtagggacactgagggccaggcctagtggctggtgtggcgggagtggcgagccagggccctgtgggtggtgaggagtagttgctggccagcctggatgacgacctctgacccatgtcgccactggagctggtggcagtggggctggggaggaaggaacgccaagggccacagagagaacccaggctccatctgggccgagacatcctggcctctgagtttgacaggggagcccactgcccggccaaacaggagctggggctgggagctcagactcagtccagcccaggtgggagtcctggggaaggagatagcccacgagcctcaccagccctgggtgacagccagatggtgtccgaagccccaggcctggggcaggcagggggtgtctgggccagggatgaacggaggccaaactgggtaacaagcagagtcgggtgtgcagtgtctcataggcaacgtgaggagtgtttgagcaggagccggggcaggaggttgtggaaggccctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacgactc

SEQ ID NO: 951 - DNA, 2505 bp, Homo sapiens
gagcggagggttggggtctggcctcccgcgccggggcgaaggggcagccgcagcgcagaggcccgccccgccctcccctcccgtcacgcccagcctcccggcccttgggctgctcgcggcctttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccggctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttcttatgccttccttgca

SEQ ID NO: 952 - DNA, 2080 bp, Homo sapiens
tttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaat

SEQ ID NO: 953 - DNA, 997 bp, Homo sapiens
ctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccggctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggaggtcaggc

SEQ ID NO: 954 - DNA, 1002 bp, Homo sapiens
atctgaagtctaggactgccagggcaacatggtacctttggctttacatttccctggagaagttgggctccaagagacagcagtcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttctt

SEQ ID NO: 955 - DNA, 2504 bp, Homo sapiens
agcgcaaggtgacgggcgtggacgcggctgtggggccgggagcggagggttggggtctggcctcccgcgccggggcgaaggggcagccgcagcgcagaggcccgccccgccctcccctcccgtcacgcccagcctcccggcccttgggctgctcgcggcctttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttcttatgccttccttgca

SEQ ID NO: 956 - DNA, 738 bp, Homo sapiens
gggaggcggcgctggcggggggcgctgcgggcgctcatggcggcggccgccgggtaaggcgggcgcagcgcctcaagggagcggccggggccggcgggcctggcgccgcggtgtccgcggcagcgccgccctgagccggagaagctttcccgggcaacaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccc

SEQ ID NO: 957 - DNA, 545 bp, Homo sapiens
gcggccgccgggtaaggcgggcgcagcgcctcaagggagcggccggggccggcgggcctggcgccgcggtgtccgcggcagcgccgccctgagccggagaagctttcccgggcaacagctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtct

SEQ ID NO: 958 - DNA, 896 bp, Homo sapiens
caggcatgagccatcacggccggcctaacagtaaatgttaaaactggaaagccaccgtattacagatgaggaaactgatttgcccaaggctacatagccaggatagggatctagagttcgactctctgcccccttctccttttgatacatcctgaaaacttttattcatctatctcttcctccatagctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttc

SEQ ID NO: 959 - DNA, 3894 bp, Homo sapiens
cgggatgcaccgctgcggggaccccccgcccggcctcgcggacccgcctcggcccaggacggaggaggaggtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcagacgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcagggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgcagttaggactcagactggtcaaagatttcaaagatttctccacagaaccgtctcagttctaattgcactccctcatgcatgtcactttctcaggggctcgctttgttatagaccctttcgcctcgccaccttgcctgtcctcaggacgctttcacaggtgctaagtgatctcatttttcccaggtgtgtttggccacaaagagcagcttctttctcaaaatgagttagaagtggcagtgggacaggagcggaaggaccacaccaggagacacttccatcctgaagcttaggtgcctcatctccacagggcggtggcagtccctgcctgccaccccacagggttacagcaaggattaagtgagatcacagaagtttaagtacacactgtcaaccgtggggtcatcgtgaaccaacccactttgcactgtttgggagacagaaacctggctaaacatggcactgcaatgggcctgaacaaaaggcagaatctttaaaaattcctcttaaatgactctggagatacctggaaatgaaagtgccaagaaaggtgttccattttatttgctaactatttatgcattagctccccaagggtcattctcagattctcctggaattcttctccctcaggacccatggttcaaggaaggaagcttaggccctgttccttcctgtcctttgctggtctttcccttttttcctttctaggagggaagcttctgtgctgctgccctgagcccttccttcaggccagcacagtacctggggacctccacgggggaatgggatccaggccaggttgcttgctgagcctcatcacccaggaggcctgagcctctggggagggcacgcatgtacactgccagacccaggggagatcttgggaacagaggatgctacgtgatttcctctggcttccaacccaatcagcctgcatcacagtgaaacacaacacaaaaggccataaaaggcatacccctgagaaatgtttaagggcaggtgctagagtcagtgccagctccctgggaggagggatagggacgggcagatcagtagccagcttgtcctcaccctccggaagggagcaccggagaagacttgcacacgtccctgcctcccttgcggccttgtcaccagagggacacatctcctgggcacaatgtgcagggctgacctgggagacttctcaggtggctgctggctgaggagaggccaggccttcccaaggaagaccctgagtaaaatctgcatctgtcctcaccacctggcacagtctctcataacggtcagattttgtatgttcatcctatttattcaggggctcgtactagaaagccacaggagaggtcggcttgtagggactggaaaatcagccccaagcagagcagctgcagggcccctggagccggaaggacactgcacagaacagactgcgttattgttatttttaaataaaaatatacatttgaaaccttaaggctaaacaaaaataaacaaaaaatcctttagaattctttccacaacaatatctctttctgagaaattgttacaaacaaggtcagattttctctgtataacatttgcttttatgaggacaatatcatatgcattatatgcataatatgatattataaatcaaaatgcctgcacccactttagggtatagctattgacttattattaatattatattattattattttgctggaagaaggtcacactaagatataattttttatgttttcagttaacggtatgctttcttctttgcttatttggtttttgtctctgtaccaaatatcttcttgcttaaggtagaaaagtatttgtttacctctatctccagttttttttcttatttgaatgttgaaggtaaaattgatataccaattttaactatttctgatacagctgaaagcactaaactacttcataagaagtagatactcatttttgtaacactatttagggcttttgtggttaattttaaaggaaaccactctttctacaggaaacaagggctcaggattcttcagatgaccttataaaaatgcagtccacagtgctatcaatattgtaacagtaatgactacaataaagccaaaagtccagtgta

SEQ ID NO: 960 - DNA, 2045 bp, Homo sapiens
gagggcccgtgtccccgcggaggtcaaggccgagagagggcccgtgtccccgcgcaggtcaaggcccagagtccccgtgctcgcacagatggtgtcctggggcccagtcgcgctccccgctcgcggcagcccccgtgtactgggccttgcaaagtccgttaggagcgctccagggcgacagtgcccagcggttaacaagtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagatggcgttattccctctggtccccactgctctggccaaaccttctctctgctgactgcatctattgctgtgagctgattgtcctctagtttctccatctcctgaggcatgcttcacaccactgccagaagagctgccagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcagacgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcagggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgca

SEQ ID NO: 961 - DNA, 1856 bp, Homo sapiens
ggccttgcaaagtccgttaggagcgctccagggcgacagtgcccagcggttaacaagtttgtaattactttcgtgggtttctacgttgcaaattgagaagagggttgctgggttgggcccccctcctctggacgctaaccccacccaggtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcagacgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcagggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgca

SEQ ID NO: 962 - DNA, 897 bp, Homo sapiens
tcgcggcagcccccgtgtactgggccttgcaaagtccgttaggagcgctccagggcgacagtgcccagcggttaacaagtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcagacgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgat

SEQ ID NO: 963 - DNA, 432 bp, Homo sapiens
gtgtactgggccttgcaaagtccgttaggagcgctccagggcgacagtgcccagcggttaacaagtttgtaattactttcgtgggtttctacgttgcaaattgagaagagggttgctgggttgggcccccctcctctggacgctaaccccacccagggatgttgtgaaacaaaagctgacatttatatatatatacatatatacagtatttgagttcctcagtagaaagctatcatatatactcagatggcgttattccctctggtccccactgctctggccaaaccttctctctgctgactgcatctattgctgtgagctgattgtcctctagtttctccatctcctgaggcatgcttcacaccactgccagaagagctgccagaatgttttggacgtttaaagaatggttctggttggaaagattctggc

SEQ ID NO: 964 - DNA, 638 bp, Homo sapiens
gatggtgtcctggggcccagtcgcgctccccgctcgcggcagcccccgtgtactgggccttgcaaagtccgttaggagcgctccagggcgacagtgcccagcggttaacaagtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcagacgtgtatttgaaaa

SEQ ID NO: 965 - DNA, 1769 bp, Homo sapiens
ggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaa

SEQ ID NO: 966 - DNA, 713 bp, Homo sapiens
ccacggccccgccccgggctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccagcctcaaatgggtctgccttccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcaga

SEQ ID NO: 967 - DNA, 758 bp, Homo sapiens
gtgacctgggagcagcagaaatctggaaactgacagcatggacgtgctggccgcagcttccaggatctgctccgtcacccaggctggagtgcagtggtgtgatcacagctcactgcagcctcaaactcctgggctcaaccagtcctctcacctcagcctcctgagtagccgggattacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcac

SEQ ID NO: 968 - DNA, 1357 bp, Homo sapiens
gccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgccccc

SEQ ID NO: 969 - DNA, 568 bp, Homo sapiens
actgtccccctcggggcttcccatcatggccgtctccccgagctatccgcgctcccccacgagggccggggcgcaacgggtgcccgaggacgcggctgtgaaacgggctggagcgagtaggggcgatcctggcctcgtgacgcgggggaatccggatgtgtgagccgggggagcgccccgtttccccgacgtgccagggctggggacgcagctggggccctggcctcggagtccgcagcccggccgcgtagacggcttctgagaaccgcttaaacacgtcattccaagcccgagctaacccatcaggcggccggggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgt

SEQ ID NO: 970 - DNA, 531 bp, Homo sapiens
attatctttcttttccaggtgtgcaaacaagctcttggagggaaggagaggagaaaataaacaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagacctcccagctaactggaacctgtgtccacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggc

SEQ ID NO: 971 - DNA, 2024 bp, Homo sapiens
ccagaaggggccggaagggggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgttt

SEQ ID NO: 972 - DNA, 2998 bp, Homo sapiens
ggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcattcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaagatggaatctcgctctgttgcccaggctggagtgcaatgtcacgatcttggctcaccacaacctccacctcctgggttcaagcgattctcctgcctcagcctccctagtagctgggattacaggcgcatgccaccaggcctggctaatttttgtattcttagtagaaacggggtttcactatgttggccaggctggtctctaactcccgaccttgtgatctgcccaccttggcctcccgaagtgctgggattacaggcgtgagccaccgcacctggcctgcctgttttaccttttaagatgtgacttagacgcaagaggaaagttctaccttcttcctgtcccttaggaatggcttttgttaaaggatgatagggttaagagttttttaagagatggcctcaaccatttcctaccccttacctacctgcttcagtggatttcatatttttctttttgacatggggcccttttcaaaggaaatcatatgcagaaccatataaactgtataaaagcagattgttaagttgcctagaagtggtgtgtggtagttcacaagccaccacaaggtgaccatgctgtgatattcaagatatggtttatataaggaactaaatacccacctcaccccactagtgtatgaggcaagtgtcctaagtgaatgggtatgtagtgtttcaaatacccatcttatgccaagagcgaaagaaaggtgccacttaatgataaactcataattgaactttgcaagttttgaagcagtcagactgtagtcaaagggctagggatttcagcctaaaggaatacagaatcccaagtgggaggggctctgcttgagcaggtactgatactaggaccaagtgatggaatgtggcctagatattgatgatctcctgcatcattattccttatagctgccattggctcagaacttgctcagtgtgcctgtgcatcttgctgtagctactggacatctctgttctctcctgcttttctttcctgactaggtgacctgtccaggaaggattagaccctgtactctccactctttcctcacctccttccttttttctatgcctggcgggagctggacagtttcatctcttgcatgtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaaccca

SEQ ID NO: 973 - DNA, 1521 bp, Homo sapiens
gtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagagatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagc

SEQ ID NO: 974 - DNA, 951 bp, Homo sapiens
aagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcattcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctgtttttctgttctattctattctactttcgccaatagaacacaagaaccctattgccctgcttttaccttagcctgtgctgaccttctgtggactctcataggacctctgctgcctcagaccgtatttctagcaa

SEQ ID NO: 975 - DNA, 7214 bp, Homo sapiens
agggctggttctgaagcttggcggcagcccctacctgctgacccaccgcctccgggcgcacgggaagaggactgagagccctgaaaccccagcggggcaggagccagcattctgagcatgtgcgagccagccagggggctagggcggatttggggggtcgactttaggtcgtcgccctaagcgcaaagcgaaagagcggtgagagcaggggcgggcgacactccccggagcggtgcccctgcgcccagggcgcagcgactgcgccctgccctgcgggtgtgggcgagttggccgcgtgtgtgcctcgctgtttgacgcgaagacgagccaatcagggcgggcggcccgagctgccatgtgacgggcaaggcggcccctttccccagcgcggccagagggaggagagaaccggggctcgccgcgagccttcgagagcagcggccgcggaggaggcggcggcggcgggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagagatttgtagccaaaccgtgcgccatagccctcaacattcaggccaatggaccacaaattgctccgcccaatgccattctggaaaaggtcttcactgcaattacaaagcatcctgatgaaaagagattggaaggcctctccaagcaactggactgggatgttcgaagcattcagcgctggtttcgacaaagacgcaatcaggagaagccaagcacgctgacgaggttctgtgagagcatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgtggacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagagtgca

SEQ ID NO: 976 - DNA, 6851 bp, Homo sapiens
gcggccagagggaggagagaaccggggctcgccgcgagccttcgagagcagcggccgcggaggaggcggcggcggcgggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagagatttgtagccaaaccgtgcgccatagccctcaacattcaggccaatggaccacaaattgctccgcccaatgccattctggaaaaggtcttcactgcaattacaaagcatcctgatgaaaagagattggaaggcctctccaagcaactggactgggatgttcgaagcattcagcgctggtttcgacaaagacgcaatcaggagaagccaagcacgctgacgaggttctgtgagagcatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggctgggaagtggaaccctttacatgtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgtggacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagagtgca

SEQ ID NO: 977 - DNA, 2945 bp, Homo sapiens
gtcttctgtcggagtccgccggtccgcagcctgcggcagggaggcccgggcacccgcaggtggcgccccacgtccgtgtttgcgccctcagccgagctccaggcgcagctgggaaacccagcgcgtctccccgggtcctttgagcgagcgcggacaccgcaatttaataaataagcgcaagcgccagccgctccaccagtccgaggtccagaggagcagacacacagacccgggccggaggcccctcttctagccctgcgggaaccggacagttccccaactgggactctggaaccacagctcctaaatcatcaaattctcaagctttttttttccctctcttcgtcccagccatcccagtcttcttcttcttttttttttttttaacttattgtttttttcgctcctgtcattatgaaagtggtcacgccattcaatattaagacttggagggaattggggaaagaaaagaaagaatctaaaagaagagaagcgaccggtgcttttaagggtgtctaattttcaaaagagacgtctgggagtattttgctctgggcgtttggagcaacttcgcggacagcggagctcgcccagcatggatgttccaggttcacaggcgcctttcttctgagaacgaccctggccttgaacgtcagagccggggacgaaggcccccggaggctgctgcgagctccgcgcgttccttcgcgcccttccgcgccgctcgcgccggcgccggcctccacccccgcgcgccgcctcccaccagtcccgatgcaggcgcccggccgggggccactcgggctgcggctgatgatgcccgggcgccggggggcgctgcgcgagccgggcggctgcggatcctgcctgggggtggcgctggccctgctgttgctgctactgcccgcctgctgccccgtgcgggcgcagaacgacacggagcccatcgtgctggagggcaagtgcctggtggtgtgcgactccagcccgtcggcggacggcgccgtcacctcctccctaggcatctccgtgcgctccggcagcgccaaggtggccttctccgccacgcggagcaccaaccacgagccgtccgagatgagcaaccgcaccatgaccatctatttcgaccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattgggaacctgtcaagaagtgctttatccagagaagcaaattttgcacgattggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaacctggtgttcctgagtggtcctgaatcatataagttggtaatggaagctgtaatgaccaagtcccctaaacatactatgtctttgccacgtgtgctgtgacttctctgtgggtgatttaatttatttggatccacctctgagtgagcgcacagtgatcaggtgcttcaaagccaacagaccagctcctcttcctccggatcctcttttgatctgcccaggaaagggatgcattgacactctcctgcatgcacctggcgagaagccacctgaaagtcactgtggttaaagatattggtggaggtaccccaggagcactgttacaaatccttcttgttttggcatctcgtacaacattattaagacacagctgagagttgatgggtgtgtaatgcatatgccaaggaaatgtcactaatcccaaagcaatcaaaaaggagacctcaaaccagatgttaatttgttctttgtgtaacaatgtaaccaaaatattgatgataaaagtcataatttaagattcagaataaatgggtttgatgtctggc

SEQ ID NO: 978 - DNA, 2685 bp, Homo sapiens
ccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaa

SEQ ID NO: 979 - DNA, 5197 bp, Homo sapiens
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaa

SEQ ID NO: 980 - DNA, 1176 bp, Homo sapiens
cggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctgacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcgg

SEQ ID NO: 981 - DNA, 2147 bp, Homo sapiens
atgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaat

SEQ ID NO: 982 - DNA, 551 bp, Homo sapiens
aagtctaagcagaatgggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctg

SEQ ID NO: 983 - DNA, 887 bp, Homo sapiens
ggaaagggacctgtctgaggttggtgacagacacccagttcgatcccatctgtggtgccgccaggccgctcccttttctgctcctctcccgagaggctgcagagttctttccctcccagcagggtcctaaggaccccggcggtgctccaggggagccaacatcccctgctttggaggacggacgggtcgggtcgcagtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactaggt

SEQ ID NO: 984 - DNA, 530 bp, Homo sapiens
aagggagaagaaatctggcatctctccagaatgcttctcattgcagggccgctggcctagaaatggcctcaaatggaagctgccacccgatcctggtggaggctttgagctaggctagagatcaggactccagggttcagtgcgcacgtgctgcccctgcactaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagg

SEQ ID NO: 985 - DNA, 1393 bp, Homo sapiens
gagcaccttggcgcgcggagctggcaccttggcgctgttggtggcggcggagacagctgtgaagtgtgaggttctttgtctgctggcagctaggggcgacgaggcgggacgtcatggaagtgaaggatgccaattctgcgcttctcagtaactacgagacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacgggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaa

SEQ ID NO: 986 - DNA, 3009 bp, Homo sapiens
gttgcagtaagccgagatccagcctgggcgacagagcgagactccgtctcaaaaaaaaaaaaaggttaaagaaaaaaagaaaagaaaacacaagataatcctgtccgcaaacgcttagcagtcttaaatcggcctggtggaaggatgcagggacactcccccaccctgccccccgaaaaaggggaacgcgcagcgcgaggttccgggtccgccaagctcccggcatgcagcgcggcgatcccggcgagcaccttggcgcgcggagctggcaccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacgggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccgtccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaaccggggaggcagaggttgcagtgagccagatcgtgcattgcactccagcctggccgacagggtgagactccatctcaaaaaagagaaagtaccagattgtacttttaaatctgtctagcgtattgagaattttagtgggagctgttgatttatttctcagggcatacatgtgccaatctgtctcattgttgtctctctcttttttttttttttttttgagacagtctcgctgtgttgcccaggagtgcagtggcacgatctctgctcactgcaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 987 - DNA, 492 bp, Homo sapiens
gatcccggcgagcaccttggcgcgcggagctggcaccttggcgctgttggtggcggcggagacagctgtgaagtgtgaggttctttgtctgctggcagctaggggcgacgaggcgggacgtcatggaagtagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaa

SEQ ID NO: 988 - DNA, 2555 bp, Homo sapiens
atggagatgaaggatgccaattctgcgcttctcagtaactacgagacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacgggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccgtccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaaccggggaggcagaggttgcagtgagccagatcgtgcattgcactccagcctggccgacagggtgagactccatctcaaaaaagagaaagtaccagattgtacttttaaatctgtctagcgtattgagaattttagtgggagctgttgatttatttctcagggcatacatgtgccaatctgtctcattgttgtctctctcttttttttttttttttttgagacagtctcgctgtgttgcccaggagtgcagtggcacgatctctgctcactgcaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgaggct

SEQ ID NO: 989 - DNA, 942 bp, Homo sapiens
ggcatgcagcgcggcgatcccggcgagcaccttggcgcgcggagctggcaccttggcgctgttggtggcggcggagacagctgtgaagtgaaggatgccaattctgcgcttctcagtaactacgagacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccgg

SEQ ID NO: 990 - DNA, 1866 bp, Homo sapiens
ggggccgaactggcagccaggaaatgccctggagtgtgtgtcacctgtccaggacgacttgttgattcccaggagggccgcctttccggtctgggtccccgagaggactgccttgctcacctgtcccctcggcgcggccccggggagctcccgagaggcccccgggatcgctggccctccgaactccacagcaatgagcaagttgggcaagttctttaaagggggcggctcttctaagagccgagccgctcccagtccccaggaggccctggtccgacttcgggagactgaggagatgctgggcaagaaacaagagtacctggaaaatcgaatccagagagaaatcgccctggccaagaagcacggcacgcagaataagcgagctgcattacaggcactaaagagaaagaagaggttcgagaaacagctcactcagattgatggcacactttctaccattgagttccagagagaagccctggagaactcacacaccaacactgaggtgttgaggaacatgggctttgcagcaaaagcgatgaaatctgttcatgaaaacatggatctgaacaaaatagatgatttgatgcaagagatcacagagcaacaggatatcgcccaagaaatctcagaagcattttctcaacgggttggctttggtgatgactttgatgaggatgagttgatggcagaacttgaagaattggaacaggaggaattaaataagaagatgacaaatatccgccttccaaatgtgccttcctcttctctcccagcacagccaaatagaaaaccaggcatgtcgtccactgcacgtcgatcccgagcagcatcttcccagagggcagaagaagaggatgatgatatcaaacaattggcagcttgggctacctaaactaaaacacatttttgatacctaaattaatgagctatagataaaatataaaaaatgtttttaccaagttcagaagttaacaaagactctgctttataattatattgaatgaataattgtgttttaagcctcctaagtaaaagtaaaaaaggagtcatgtgcatacatagaatcagtgatggaggccaggcacggtatctcatgcctataatcccagcactttgggaggctgaggcagttgagaccaggagttcgagtccagcctgaccaacatgaagaaaccctgtctgtactaaaaatacaaaaattagccggacatggtggcaggcacctgtaatcccagctacttgggaggctgagtcaggagaatcgcttgagcccaggagatggaggttgcagtgagccaagatcatgccactgcactccagactgggcaacagagggagactccgtctcaaaaactaaaaaaaaaaaatacatttagtatagcggggggtgggggggagaaataatgttatttcctatgcgaatgacgtgtatccctgtacccatggtaaatgtaaatatactgtgtctcttttgggagagccttttagtagaggagtcttatatgagtctctacataagtagtttcacttgagttttgcagtttgaaatcttaaaggagctttaattgacatttattataccaattaagcttggaatggggcaatggatgcatttcccaaaacgtgtgaaagcactaacagcttatattgctgaatgagaatctcctgggtgtaatttagccacttagggaactgcgtgaacactcccaggccattatgatgctgttacagcttcagtgtataaatgcatgagtattctttctgttctgttttgtgctctcttgtacatttatttaccctttacagaatatttcttgtaaatacataaaaatattggcaattaaaagtacatcttgaataaaa

SEQ ID NO: 991 - DNA, 1316 bp, Homo sapiens
ccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagc

SEQ ID NO: 992 - DNA, 1124 bp, Homo sapiens
ccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttgcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagc

SEQ ID NO: 993 - DNA, 4803 bp, Homo sapiens
gcacgctgaaaccctgggcggcggcaagctgtgcgacctcttctgcggccggcctgggcaggtgtcttcctcgagaggcaggcaggggatcccggacccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaactttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 994 - DNA, 4141 bp, Homo sapiens
gatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttgcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaactttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 995 - DNA, 4333 bp, Homo sapiens
gatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaactttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 996 - DNA, 2078 bp, Homo sapiens
ccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggactttttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatat

SEQ ID NO: 997 - DNA, 4825 bp, Homo sapiens
cagccgaacaattcgatgacgaggcccaggaagcacgctgaaaccctgggcggcggcaagctgtgcgacctcttctgcggccggcctgggcaggtgtcttcctcgagaggcaggcaggggatcccggacgatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaactttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 998 - DNA, 2468 bp, Homo sapiens
gaaaccctgggcggcggcaagctgtgcgacctcttctgcggccggcctgggcaggtgtcttcctcgagaggcaggcaggggatcccggacactagctttatcgtcatctgggaaattgttaaaaatgcaaattcgcaagtttgagagccatggttccaagaaactgcataagcatacgaaataagttgcagcctcccgacttataccctggtacttctagtctaaaacaggatttgactctactaatccagccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaact

SEQ ID NO: 999 - DNA, 4685 bp, Homo sapiens
cagccgaacaattcgatgacgaggcccaggaagcacgctgaaaccctgggcggcggcaagctgtgcgacctcttctgcggccggcctgggcaggtgtcttcctcgagaggcaggcaggggatcccggacccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggactttttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaactttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 1000 - DNA, 1127 bp, Homo sapiens
ctccccaggttcagggcggggccggtcgggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 1001 - DNA, 1560 bp, Homo sapiens
ccaagtagctgggattacaggtgcccaccaccccgcctggcaaatttttgtatttttagtagagacagggtttcaccatgttggccagtctggtcttgactccctgacctcaggtgatccaccccccttggcctcctaaagtgttgggattacaggcgtgagccacctcacccggcccctaactctatttcctatgcccaatcccaagtgtaggccacaaggactgcaagtcctagtgctgagctgggcccggagacagtagactgcggggggcacaggacctactgagacaccagtctgggcagctcagggagtgctggcgtcaccccttccctaatcccaggctgcatggctaacggttcctatctgcagtcccagccttccacttccgagttcttctctcagaccacagtcccagcaacccagaatttggattggagtctggaagaaatgcagaatgattaaacgaccacctttccatttgaagtccccatccctgaatcttcacgggtgtgcccaagctcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 1002 - DNA, 1254 bp, Homo sapiens
caggttcagggcggggccggtcggtgagtcagcggctctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 1003 - DNA, 1127 bp, Homo sapiens; identical to SEQ ID NO: 1000

SEQ ID NO: 1004 - DNA, 1560 bp, Homo sapiens
ccaagtagctgggattacaggtgcccaccaccccgcctggcaaatttttgtatttttagtagagacagggtttcaccatgttggccagtctggtcttgactccctgacctcaggtgatccaccccccttggcctcctaaagtgttgggattacaggcgtgaaccacctcacccggcccctaactctatttcctatgcccaatcccaagtgtaggccacaaggactgcaagtcctagtgctgagctgggcccggagacagtagactgcggggggcacaggacctactgagacaccagtctgggcagctcagggagtgctggcgtcaccccttccctaatcccaggctgcatggctaacggttcctatctgcagtcccagccttccacttccgagttcttctctcagaccacagtcccagcaacccagaatttggattggagtctggaagaaatgcagaatgattaaacgaccacctttccatttgaagtccccatccctgaatcttcacgggtgtgcccaagctcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 1005 - DNA, 1197 bp, Homo sapiens
ggatttgattggcgcagtgggaagcccgcgagaagaggtggaagcattcgaattacatcaaattctggcagagagaagtagttctgatcagaacactcacacccctactgggacatgcccataccccttcgcacttctacacacccctgaagacagagagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 1006 - DNA, 1254 bp, Homo sapiens; identical to SEQ ID NO: 1002

SEQ ID NO: 1007 - DNA, 1197 bp, Homo sapiens; identical to SEQ ID NO: 1005

SEQ ID NO: 1008 - DNA, 1197 bp, Homo sapiens
ggatttgattggcgtagtgggaagcccgcgagaagaggtggaagcattcgaattacatcaaattctggcagagagaagtagttctgatcagaacactcacacccctactgggacatgcccataccccttcgcacttctacacacccctgaagacagagagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 1009 - DNA, 1254 bp, Homo sapiens; identical to SEQ ID NO: 1002

SEQ ID NO: 1010 - DNA, 1560 bp, Homo sapiens
ccaagtagctgggattacaggtgcccaccaccccgcctggcaaatttttgtatttttagtagagacagggtttcaccatgttggccagtctggtcttgactccctgacctcaggtgatccaccccccttggcctcctaaagtgttgggattacaggcgtgagccacctcacccggcccctaactctatttcctatgcccaatcccaagtgtaggccacaaggactgcaagtcctagtgctgagctgggcccggagacagtagactgcggggggcacaggacctactgagactccagtctgggcagctcagggagtgctggcgtcaccccttccctaatcccaggctgcatggctaacggttcctatctgcagtcccagccttccacttccgagttcttctctcagaccacagtcccagcaacccagaatttggattggagtctggaagaaatgcagaatgattaaacgaccacctttccatttgaagtccccatccctgaatcttcacgggtgtgcccaagctcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 1011 - DNA, 1254 bp, Homo sapiens; identical to SEQ ID NO: 1002

SEQ ID NO: 1012 - DNA, 1127 bp, Homo sapiens; identical to SEQ ID NO: 1000

SEQ ID NO: 1013 - DNA, 1127 bp, Homo sapiens; identical to SEQ ID NO: 1000

SEQ ID NO: 1014 - DNA, 1127 bp, Homo sapiens; identical to SEQ ID NO: 1000

SEQ ID NO: 1015 - DNA, 1254 bp, Homo sapiens; identical to SEQ ID NO: 1002

SEQ ID NO: 1016 - DNA, 1560 bp, Homo sapiens; identical to SEQ ID NO: 1001

SEQ ID NO: 1017 - DNA, 1197 bp, Homo sapiens; identical to SEQ ID NO: 1005

SEQ ID NO: 1018 - DNA, 1127 bp, Homo sapiens; identical to SEQ ID NO: 1000

SEQ ID NO: 1019 - DNA, 1197 bp, Homo sapiens; identical to SEQ ID NO: 1005

SEQ ID NO: 1020 - DNA, 1127 bp, Homo sapiens; identical to SEQ ID NO: 1000

SEQ ID NO: 1021 - DNA, 1560 bp, Homo sapiens; identical to SEQ ID NO: 1001

SEQ ID NO: 1022 - DNA, 1197 bp, Homo sapiens; identical to SEQ ID NO: 1005

SEQ ID NO: 1023 - DNA, 1560 bp, Homo sapiens; identical to SEQ ID NO: 1001

SEQ ID NO: 1024 - DNA, 1197 bp, Homo sapiens; identical to SEQ ID NO: 1005

SEQ ID NO: 1025 - DNA, 1254 bp, Homo sapiens; identical to SEQ ID NO: 1002

SEQ ID NO: 1026 - DNA, 1254 bp, Homo sapiens
caggttcagggcggggccggtcggtgagtcagcggctctctgatccagccagggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 1027 - DNA, 2655 bp, Homo sapiens
aacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaatataagaaacaaagtcaactgaatcttttattcatagaaatgaaaaggaaaataaaaactgtggctgaccaaaaggtcttcttgttgtccataaaaggataaggtaaacagtccttagataattacaaaactttctacaaaagttaaaatgttacattactatacgtattcagattcacttgttaaagtactcttaaatcattcaaatctggaaacaaaagctgaacttaactcttgctccctcaaaagagaaacacaagcataagtgcagcttcaaaaaaggaaaatattttaggctttggtggaagggtggagtttagataaaatttaaatgaagtagcgttttaataggttcaaagaaaagtaaggcaatgagcaaactcaaagtactgtccttgaaaaccatagagtcaagataaatgtatagtgtatggttaggtggcagagaaatgcaatcatgttgataatctttgagatacatcctgtcatcagtatatttcagaatacatgcaatgcactagcaagttacaattgatagaatacatttgaaatgttaaatgaaataagccaggcacagaaagacaaacaccacatgatctcactcatatgtggaattttaaaaagttgatctcactcatatgtggaattttaaaaagttgatctcacacaagtagagggtagaatcgtggttaccaggggctagggagagaaagaaggcagaggcactgaaagatgttggtcaatgggtataaagttacacctaggaagaataaattttggtattcaccacagtagggtgactatagcaaataataatgtagcatgtatttcaagatagctagaaaagcaggtttttaaatgtcaccacaaagaaataacaaatgtttatagtggtggatatggtaattacgcctatttgatcattatactgtgtgtacatgcattgaaacaccacattgtatcccatatatatgtacaattatgtgcccattatacatttaaaaaataaattttaaaaaccttcaa

SEQ ID NO: 1028 - DNA, 4346 bp, Homo sapiens
aagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgccataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggtaaaagtg

SEQ ID NO: 1029 - DNA, 2721 bp, Homo sapiens
agagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtattttctttataatttcttgaacaggcaaatgaaagcttattatagaatgcatgtattttcttttatctttggaacatcagcaccagtatattgctggcagctattgtattaaaaaataaagtatattttcactatc

SEQ ID NO: 1030 - DNA, 2723 bp, Homo sapiens
agagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtattttctttataatttcttgaacaggcaaatgaaagcttattatagaatgcatgtattttcttttatctttggaacatcagcaccagtatattgctggcagctattgtattaaaaaataaagtatattttcactatc

SEQ ID NO: 1031 - DNA, 3806 bp, Homo sapiens
atggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggctggttatgatggtgagagtatcggaaattgcccgttttctcagcgtctctttatgattctctggctgaaaggcgttatatttaatgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccacagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatacttctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatggaaccaa

SEQ ID NO: 1032 - DNA, 3860 bp, Homo sapiens
atggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaaacttactgcattaggctgttctcgcattgctataaagaaatacctgagagctggttatgatggtgagagtatcggaaattgcccgttttctcagcgtctctttatgattctctggctgaaaggcgttatatttaatgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccacagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatacttctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatggaaccaa

SEQ ID NO: 1033 - DNA, 3640 bp, Homo sapiens
cgtgtccgagcgctggcggagcacgggccgccgcggcgcgcgcctacccccgcgcacacgtgcatgcagtgagccaggtgcatcagctgcacccgccctcgggcttcgcgcgcctccgctggagcccagctagcctcgcggctccggggccgaccgggtcggaactgctgcgtccccattccggacgcagagagcgcgcggggcgccggcgccgccggttaaagtgccgcggggcaggggccgggccgcggccacccgctcctcccgctccggtcccgactgtcgggctctcggccgagtcgccccggacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgctcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggcccatgcggggcacgagtgtgggctggctcaaactgagaagtgccaatccccaagaccaccctgtgatccagcccaactacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctcctgtgaaccctgatggcaccactgcactccagcctgggtgacagggtgagaccctgtctcaaaaaaaaaaaaaaaaaaaaaaacctgagatttttttggaccttattcaaggggagaggagtctggagggaatgccgcttggcttcactaccaaaggttttatgacttagcattttaaaaggttttccttttaccaagaaatgcagaaaccaagagcaaaccccacgtaccagatcactgattcctactgaagcagctagcccgagaaaggactctctcatactggtcttgggaaatgacttggcagcctgagccatcccagcagtggacaaggatggttaattcttattctgtagacgtccacaggaacagactaggatggaaaacacagttaagcacagccatgcaccctgtggctgtagaaatgcccctgtgtgaaagaaaaataaattcaagactggagttttggaggaaaaaaaatacaagtagcatttacaacagctctttgctctttaaatttcttaccattcaataaagtgatccagtcactcacatttgaactga

SEQ ID NO: 1034 - DNA, 565 bp, Homo sapiens
ggctagtccctctgagacgagcgagcaggcagccattcactaacatgcgttcattccacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgctcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgc

SEQ ID NO: 1035 - DNA, 631 bp, Homo sapiens
tcggcacacaggctttgagacaaccagggtgcggagacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgctcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcc

SEQ ID NO: 1036 - DNA, 1585 bp, Homo sapiens
tccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatattaa

SEQ ID NO: 1037 - DNA, 1881 bp, Homo sapiens
agcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggctagtataccatcaataaggttatatttgaatataaaacataaaccctgtagatttcattgtgtcttatttcagttatgaagcccccattgtatcatcattttttatcacagatgttctcagaattgtctacatattaattagaaacaagactaaagaaatgtcaatcctgaggacaacagtgaacccctgtaattctaagtagcagtttgtctctgagacttatcagacacagggttttcactgccaaaggattacataaatattcagaacataaaggattttagccatcttgagggtgcttactttgactgctaaaaactgaaaagtgattcaatactgcttaagtgcatggcttataatgtaattattgaatcaagttatgttctaagaaattttttatactaatcatttttcaagaggcatattagtatgttataaaatacttgcttttagtatactagaatttaaaagggctacaggaattttttaaataaaatttgtatttaataaaaggaatttgttgtacc

SEQ ID NO: 1038 - DNA, 2198 bp, Homo sapiens
gtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactg

SEQ ID NO: 1039 - DNA, 2251 bp, Homo sapiens
cgaagcactaggccgtttgaggatctccgctccgctttgcctgggaccaggaaaagacgcgagagacggaactcggcatcaggcactgcttggggcaggaggagagtaggggaaaccaaggaagagaacagaaaggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactg

SEQ ID NO: 1040 - DNA, 3674 bp, Homo sapiens
gggcttgttctgggatccgcagccttgctcaggctgtgcattggtgtggccccgaattgcacggagctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaacacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaaaatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatg

SEQ ID NO: 1041 - DNA, 3872 bp, Homo sapiens
ctccttaggtggaaaccctgggagtagagtactgacagcaaagaccgggaaagaccatacgtccccgggcaggggtgacaacaggtgtcatctttttgatctcgtgtgtggctgccttcctatttcaaggaaagacgccaaggtaattttgacccagaggagcaatgatgtagccacctcctaaccttcccttcttgaacccccagttatgccaggatttactagagagtgtcaactcaaccagcaagcggctccttcggcttaacttgtggttggaggagagaacctttgtggggctgcgttctcttagcagtgctcagaagtgacttgcctgagggtggaccagaagaaaggaaaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaacacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaaaatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatga

SEQ ID NO: 1042 - DNA, 4232 bp, Homo sapiens
agatgcgctcggtcctcaccagcggcgttgtgcggcgaaccctgcggtgcttcgggaaggcggtcgttcctccctgctcccaccgttttccagcgtgtgcgctcttaccttctctggggaaaaaaggaaattttttattttttaacatttcatttcatgaaaccgttttttttaagtggtggcgctgaacacagtccttgcagaggggggcagcactttccctcctgaccccaacctggaaaccccagtgtgacttcagcgctgtcagagcattggaagcagagctgcgagttaggaagcggctcgctggcagctgggcacgtttctttcctgcgagatcggcttttttgatttgctctttttcacatgaaaatgttcagcttcatttttagacacctttagacatggttatcactgtttaaagccttgatttttttttaaacaaatagtttgcattttattcattgaaacagggagagaacaaataccatcctgctttttgggctgccttcctatttcaaggaaagacgccaaggtaattttgacccagaggagcaatgatgtagccacctcctaaccttcccttcttgaacccccagacataaagggagcagtaggcataaaatgtggggagctgaccatctgccggtccggtcctgaccttccactagtagtgagaccaatccagctcttgctgctgctgtggctttgtgaggaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaacacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaaaatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatga

SEQ ID NO: 1043 - DNA, 766 bp, Homo sapiens
gcctgcctgtgtgtgctggaggtggcggtggatcttttattacccaacactccacttgcctttttagcctttcctctccctcttctctcctggcctcccagtggccgtcaggggtccctgcagacatcgcttacccacagtggtgcggtgtgagagttacaggggttcctgaccttcgctgtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggca

SEQ ID NO: 1044 - DNA, 646 bp, Homo sapiens
agatgcgctcggtcctcaccagcggcgttgtgcggcgaaccctgcggtgcttcgggaaggcggtcgttcctccctgctcccaccgttttccagcctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaa

SEQ ID NO: 1045 - DNA, 1990 bp, Homo sapiens
ctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatga

SEQ ID NO: 1046 - DNA, 792 bp, Homo sapiens
ggcctcccagtggccgtcaggggtccctgcagacatcgcttacccacagtggtgcggtgtgagagttacaggggttcctgaccttcgctctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgct

SEQ ID NO: 1047 - DNA, 554 bp, Homo sapiens
aggctccgcggctgccggagcgggaggtggagccgagtccgcggcggccgcgcaggagggaaagttcagcgacggcggcagcggccggagccgggccgggcagctagcagggcgcttcggctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccggg

SEQ ID NO: 1048 - DNA, 2012 bp, Homo sapiens
acaggggttcctgaccttcgctctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacagtcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatga

SEQ ID NO: 1049 - DNA, 1337 bp, Homo sapiens
cggcggcgggcccaaggcgtgaggcgccgcccgggtgtccccgcggcgcaggaggcggtggagcgcagagcgggcgagcgcgaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagaccagggcaaccagtctgaaacgccaaattgcccaactaaaacaagaattacaagaaatgagtgagaagatgcggtcactgcaagaaagaaggaatgtaggggctaatggcataggctatcagagcaacaaagagcaagcacctagtgatcttttagagtttcttcattcccaaattgacaaagctgaagttagcataggggccaaactacccagtgagtatggggtcattccctttgaaagttttaccttaatgaaagtatttcaattggaaatgggtctcactcgccatcctgaagaaaagccagttagaaaagacaaacgagatgaattggtggaagttattgaagcgggcttggaggtcattaataatcctgatgaagatgatgaacaagaagatgaggagggtccccttggagagaaactgatatttaatgaaaatgacttcgtagaaggttattatcgcactgagagagataagggcacacagtatgaactcttttttaagaaagcagaccttacggaatatagacatgtgaccctcttccgcccttttggacctctcatgaaagtgaagagtgagatgattgacatcactagatcaattattaatatcattgtgccacttgctgaaagaactgaagcatttgtacaatttatgcagaacttcagggatgtttgtattcatcaagacaagaagattcatctcacagtggtgtattttggtaaagaaggactgtctaaagtcaagtctatcctagaatctgtcaccagattggcttcttccacatggtga

SEQ ID NO: 1050 - DNA, 3730 bp, Homo sapiens
cggcggcgggcccaaggcgtgaggcgccgcccgggtgtccccgcggcgcaggaggcggtggagcgcagagcgggcgagcgcgaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagaccagggcaaccagtctgaaacgccaaattgcccaactaaaacaagaattacaagaaatgagtgagaagatgcggtcactgcaagaaagaaggaatgtaggggctaatggcataggctatcagagcaacaaagagcaagcacctagtgatcttttagagtttcttcattcccaaattgacaaagctgaagttagcataggggccaaactacccagtgagtatggggtcattccctttgaaagttttaccttaatgaaagtatttcaattggaaatgggtctcactcgccatcctgaagaaaagccagttagaaaagacaaacgagatgaattggtggaagttattgaagcgggcttggaggtcattaataatcctgatgaagatgatgaacaagaagatgaggagggtccccttggagagaaactgatatttaatgaaaatgacttcgtagaaggttattatcgcactgagagagataagggcacacagtatgaactcttttttaagaaagcagaccttacggaatatagacatgtgaccctcttccgcccttttggacctctcatgaaagtgaagagtgagatgattgacatcactagatcaattattaatatcattgtgccacttgctgaaagaactgaagcatttgtacaatttatgcagaacttcagggatgtttgtattcatcaagacaagaagattcatctcacagtggtgtattttggtaaagaaggactgtctaaagtcaagtctatcctagaatctgtcaccagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtaagaaggtgttttaccctgtggtgttcagtctttacaatcctgccattgtttatgccaaccaggaagtgccaccacctgtggagcagcagctggttcacaaaaaggattctggcttttggcgagattttggctttggaatgacttgtcagtatcgttcagatttcctgaccattggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaagttaaatgaaaa

SEQ ID NO: 1051 - DNA, 4080 bp, Homo sapiens
agatacttaaataattaacaaaatatatttaaaatgagtgggagaacttcctccattaaaccctgttgaaaatgtgtgagtggttgtcatgccccagacatcaaggaacccatccatgaggtcttcccacacagactggcctcaggaagggaaggaggaggtaggccgctctgacagccacaacccgagttgaggaaacaagcaaaggaacacagagagtctacatacagtaaaaggtgacaggagttaagctgcacacaagggaagcagagatgggttggaggcagttaagggtgcgttgctgcctctgtggctgaggtgagtgcaaagccctacatggtcccctgtttagagaaggctattgtttcaaacatattttacttggtccccggaggcagcatgaaactatgaaagaaagagccttaccccttttttcaaggctctccagaccacagttctgggatgggtgtgggtggttgccattcgttcatttatgcctgtctgatatggagcctccctctgttaccagccctgtgcactcaagtgccttgcagtccagtgaggaataactgtagataagatgagatgatgggcattaagtgtaactgctgagaagccttcatagagggaaaggtgataagaactgagtttttctggcatgaggagtttaccaggcaggagaggtggagacgctaggctaggcaaataggctgcagccatagttctgctgagaaacaggttttgaaccaaggcaactccatctggagatatgtatcagaaagattaggagatagaatctccatcttggtcacttatttggtcttctaagacagcaatgggaccgtctcttaaatactggagttgtcctatctccttgggctgataccctgaactgtcatttgggtgagtaacacattaaggggtagacggtcggtttgggggaataaactaagtaactaggttgcggttcctcctgccgactaagcagacctcctggtgcgtggtcttgggttgccctgtgagccctgaagctgtgaatgggccccacagatcactctaaagccaagcatccatgtgtgcccggctggggatctagacccccctggtctacccaggaacctgagttttggtggtctgagacacctgggggacgacgtatcccggagaagggaccaggattaaaggccgctccccaggctgcccggagactagaaggaaggcgaggtagccgcagtcccagggagggtcttaccccttgctcccgggatgcgttatggcgggcctggctgtgcgagatctaggctagtggctttggctgcgaacggattagatctgatccgattagagcctgggcggtcggcttcgcccccttgccaggctctgccaacgcccgcccctccctcgtggagacccggagacctccctgagagccttcccgcccggaacacgggattggtgcagaatccgagaggctccatgcgccccgggcctggcttgtttccacagtgggggctcgtgcttccgccccctgcggctcttctggaccccgccccgaccctgcgggtaactgggcccgcgacgtccccgcctccgtgcttgccgcgtggcgggtgggttcctccgggtcggggccccgtgccgcctgttcacctggggcgggaccgtggccccatcccacaggtctcccgcccgtgcacctgccgcctaacgccgcgcgccgcgccgtgcgcctgcctcgcgctccccgtccgcctgccccgcactccccgtccgtgtgtctcctagtccccagcgaggggtctgtctgttcccctggcaggctgaccaaggggccggcgtcaccgctacgtgcggcggggccggcgcggcgggcggggtgagggcggcgctgagcgcagcggcggcagcggcggcgcgggaggcggggaggcgcggcgcgccggggacagcggcggacggcggcggcggcggcatgcggctcctcgcgctgcccatcgtgggctgaggcggccgcagaaccggcgggaggcgcggcggccgggcgagccgagggcgcagccagccgggcggaccgcggacagcggtcggggcgccgcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagtt

SEQ ID NO: 1052 - DNA, 4161 bp, Homo sapiens
agatacttaaataattaacaaaatatatttaaaatgagtgggagaacttcctccattaaaccctgttgaaaatgtgtgagtggttgtcatgccccagacatcaaggaacccatccatgaggtcttcccacacagactggcctcaggaagggaaggaggaggtaggccgctctgacagccacaacccgagttgaggaaacaagcaaaggaacacagagagtctacatacagtaaaaggtgacaggagttaagctgcacacaagggaagcagagatgggttggaggcagttaagggtgcgttgctgcctctgtggctgaggtgagtgcaaagccctacatggtcccctgtttagagaaggctattgtttcaaacatattttacttggtccccggaggcagcatgaaactatgaaagaaagagccttaccccttttttcaaggctctccagaccacagttctgggatgggtgtgggtggttgccattcgttcatttatgcctgtctgatatggagcctccctctgttaccagccctgtgcactcaagtgccttgcagtccagtgaggaataactgtagataagatgagatgatgggcattaagtgtaactgctgagaagccttcatagagggaaaggtgataagaactgagtttttctggcatgaggagtttaccaggcaggagaggtggagacgctaggctaggcaaataggctgcagccatagttctgctgagaaacaggttttgaaccaaggcaactccatctggagatatgtatcagaaagattaggagatagaatctccatcttggtcacttatttggtcttctaagacagcaatgggaccgtctcttaaatactggagttgtcctatctccttgggctgataccctgaactgtcatttgggtgagtaacacattaaggggtagacggtcggtttgggggaataaactaagtaactaggttgcggttcctcctgccgactaagcagacctcctggtgcgtggtcttgggttgccctgtgagccctgaagctgtgaatgggccccacagatcactctaaagccaagcatccatgtgtgcccggctggggatctagacccccctggtctacccaggaacctgagttttggtggtctgagacacctgggggacgacgtatcccggagaagggaccaggattaaaggccgctccccaggctgcccggagactagaaggaaggcgaggtagccgcagtcccagggagggtcttaccccttgctcccgggatgcgttatggcgggcctggctgtgcgagatctaggctagtggctttggctgcgaacggattagatctgatccgattagagcctgggcggtcggcttcgcccccttgccaggctctgccaacgcccgcccctccctcgtggagacccggagacctccctgagagccttcccgcccggaacacgggattggtgcagaatccgagaggctccatgcgccccgggcctggcttgtttccacagtgggggctcgtgcttccgccccctgcggctcttctggaccccgccccgaccctgcgggtaactgggcccgcgacgtccccgcctccgtgcttgccgcgtggcgggtgggttcctccgggtcggggccccgtgccgcctgttcacctggggcgggaccgtggccccatcccacaggtctcccgcccgtgcacctgccgcctaacgccgcgcgccgcgccgtgcgcctgcctcgcgctccccgtccgcctgccccgcactccccgtccgtgtgtctcctagtccccagcgaggggtctgtctgttcccctggcaggctgaccaaggggccggcgtcaccgctacgtgcggcggggccggcgcggcgggcggggtgagggcggcgctgagcgcagcggcggcagcggcggcgcgggaggcggggaggcgcggcgcgccggggacagcggcggacggcggcggcggcggcatgcggctcctcgcgctgcccatcgtgggctgaggcggccgcagaaccggcgggaggcgcggcggccgggcgagccgagggcgcagccagccgggcggaccgcggacagcggtcggggcgccgcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgtaaggaaactttgcaacactccccgtacctcctccccccatgcccgtgccttggctcactatgataacgttatctgtcaggatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagtt

SEQ ID NO: 1053 - DNA, 2089 bp, Homo sapiens
gtgtgatcctcgtcttgggggcagactccgggacggggcttagaggtaccgggtggctggggtcacactggggcggtggggtctgagggtggcgaggtctgggttgaccaggtctaggcgagcgggcctgaccggggcgggccggggctccagggctcctcagcgcgccgccctgacgtcccgccccttgccctcccgcccgcagcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagtt

SEQ ID NO: 1054 - DNA, 2548 bp, Homo sapiens
gctgctgctgtgatccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 1055 - DNA, 2437 bp, Homo sapiens
gctgctgctgtgatccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctg

SEQ ID NO: 1056 - DNA, 2239 bp, Homo sapiens
gcttgaagatggcagatcgtgggacttctcagcctccataattgagtgagccaattccctgaatacaacaagaagatgcccatctgtagaccaggaggtggtccctccccagaaactggatgggccagcacgttgattctgaacttctagcctccagaactgccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 1057 - DNA, 2421 bp, Homo sapiens
ctgtggtgtttttcccccgctcctctggctgccttcctgatggatctctgtggtcccaggcaggaatggcctgcttggggacccagcgagctcccaaggcctttcctgctgcttcctctatccctgtgttttgcttggctctctaaattgactcagctccaggacatcaggaccccaggttctctggtcttgggactctgagacttgcaccaggaatcctgcccaggctctcaggcctttggactcagactgagctacttcactggctttcctggttctccagcttgaagatggcagatcgtgggacttctcagcctccataattgagtgagccaattccctggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 1058 - DNA, 2036 bp, Homo sapiens
gcttgaagatggcagatcgtgggacttctcagcctccataattgagtgagccaattccctggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 1059 - DNA, 2136 bp, Homo sapiens
gcttgaagatggcagatcgtgggacttctcagcctccataattgagtgagccaattccctgaatacaacaagaagatgcccatctgtagaccaggaggtggtccctccccagaaactggatgggccagcacgttgattctgaacttctagcctccagaactgccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatga

SEQ ID NO: 1060 - DNA, 1139 bp, Homo sapiens
gttcttcagaagctgttcgatggcaacgtggcggacatggagctgtgaggccaaagaatctttttcttgcacttggacatcaggaccccaggttctctggtcttgggactctgagacttgcaccaggaatcctgcccaggctctcaggcctttggactcagactgagctacttcactggctttcctggttctccagcttgaagatggcagatcgtgggacttctcagcctccataattgagtgagccaattccctgtgccttctattggccaaacccaacagaagccagagaagaaaggtgaccattgatgtggttcacaaatgtctatctgctgggacacagagaagagtaaagagtagatctacaggaggagaatacaacaagaagatgcccatctgtagaccaggaggtggtccctccccagaaactggatgggccagcacgttgattctgaacttctagcctccagaacttcatctagaatctggaaccttcctgttttggggggaatctcagggaggctccacttcccacaaagagacaaaggaggtaggcattcctgtctcaatgccctagcagctagggctcagacagacacaaggtggcgttatccacactcaaaaggatggcctatggagaaagagagatagtgttggagtcttaactgaccgtgattggctttggggacttggacagccctgcaaaaactgacttctgggattatgaggaaggtggaactggctcctgaatgagatcctatttgtcactgttcgatctggagcgcaaatgaatgaagcctgctgtgacttaggctgaagccactgtatggagttgcccatgtgaagagccactgagtgcagatcagtggctggaatttaggctgtccttccttgagacgtattgatgggcgcatgaagcagatgctcactgggaattgcagacatttgaaagtgaatggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacct

SEQ ID NO: 1061 - DNA, 437 bp, Homo sapiens
gttcttcagaagctgttcgatggcaacgtggcggacatggagctgtgaggccaaagaatctttttcttgcacttggacatcaggaccccaggttctctggtcttgggactctgagacttgcaccaggaatcctgcccaggctctcaggcctttggactcagactgagctacttcactggctttcctggttctccagcttgaagatggcagatcgtgggacttctcagcctccataattgagtgagccaattccctggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacct

SEQ ID NO: 1062 - DNA, 540 bp, Homo sapiens
gttcttcagaagctgttcgatggcaacgtggcggacatggagctgtgaggccaaagaatctttttcttgcacttggacatcaggaccccaggttctctggtcttgggactctgagacttgcaccaggaatcctgcccaggctctcaggcctttggactcagactgagctacttcactggctttcctggttctccagcttgaagatggcagatcgtgggacttctcagcctccataattgagtgagccaattccctggagaatacaacaagaagatgcccatctgtagaccaggaggtggtccctccccagaaactggatgggccagcacgttgattctgaacttctagcctccagaactgccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacct

SEQ ID NO: 1063 - DNA, 1637 bp, Homo sapiens
gcacactgcgttccaagttggggacttcccagaaaatgaagtcagctggagttgggccgaggtatacttggtaatgactgcaggttcggcacacagccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtc

SEQ ID NO: 1064 - DNA, 2858 bp, Homo sapiens
agccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggtcgcggccatgacagcggctcgggacaggctccttttccgcgcccctcccgccggaggtgaggggaagatgtccatgtccgggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaataatgaaacaaccaccatcggttaaatttgatgcaaaaatattgcatctaccagcattttcagttccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccctgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagtgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacatcaaaaaaaaaaaaaaaaaagacagactgttggtcttactaaggatgtttttaccagcctgcctgacttctgcaaacctaccctgtcaaggagatcaaagggacgcaggtttctgtttattctgaacaagggccaggccccgcggagtgtctttggtggatcccagataactcctaggtgctgctctcagacactgaggagttgagcaaatctgttctattctgcagaacccataggacaaataagagttctactagaattaacagcccaaaagaatagctacagctaagtgaagccacttacgtgggctttaaaaaaataatgtgttagctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcag

SEQ ID NO: 1065 - DNA, 2794 bp, Homo sapiens
agccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggtcgcggccatgacagcggctcgggacaggctccttttccgcgcccctcccgccggaggtgaggggaagatgtccatgtccgggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaattccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccctgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagtgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacatcaaaaaaaaaaaaaaaaaagacagactgttggtcttactaaggatgtttttaccagcctgcctgacttctgcaaacctaccctgtcaaggagatcaaagggacgcaggtttctgtttattctgaacaagggccaggccccgcggagtgtctttggtggatcccagataactcctaggtgctgctctcagacactgaggagttgagcaaatctgttctattctgcagaacccataggacaaataagagttctactagaattaacagcccaaaagaatagctacagctaagtgaagccacttacgtgggctttaaaaaaataatgtgttagctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcag

SEQ ID NO: 1066 - DNA, 1913 bp, Homo sapiens
ggggaagatgtccatgtccgggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaataatgaaacaaccaccatcggttaaatttgatgcaaaaatattgcatctaccagcattttcagttataatttctgaaagaccaagattggaatgactttttgtaacaagtgtgctcgcagatcgactccagtgagaagagctcggggacctcctgagccaagcttaatctcctttgctgtttgtgagtggtggctggtcaccaggaggtggccaccaggctcctcctttccccgctgttccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccctgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagtgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggt

SEQ ID NO: 1067 - DNA, 1960 bp, Homo sapiens
gtaacaggcaggaagaaagctttctgtactacaccagagggttggggctgtggatttagctactctcacctgaggctactgagcaagctgtcatgcaccatgagacaaagcccaagctgtcccaccaggcagtaagtgtggagaggttcaggcacatggcatagctgctatttcgcacaattttcactacaccagtggtgaccaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaactccagtgactgataaacaccacaggtccaaaaactgcaagttatttgctgccagcaagaacgttaggagaaaggcagcttcaactctctccgacacaaagaatatggagataataaattcaactattgagacccttgcacctgacagcccctttgaccacaagaaaactgtgagtggctttcagaaacttgagaaactggaccctattgcagcagatcagcaggacacggtggtcttcaaggtgacagaagggaaactcctccgggaccctttgtcacatcctggtgcagaacagactggaatacagaacaagactcagatgcacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagaggccagccttttatcaagaagatgcacttcaccataaggctaacagaaagtgccatcacatacagagacattgtagtgaagaaagaggatggattcacccagatagtgctatcaactagatcgacagaaaaaaatgcactgaatacagaagtaattaaagaaatggttaatgctctgaatagcgctgctgcagatgacagcaagctcgtgctgttcagtgcagctggaagtgtcttttgctgcggtcttgattttgggtactttgtgaggcacttaaggaatgacagaaacacagcaagccttgaaatggtggacaccatcaagaactttgtgaatacttttattcaatttaaaaagcctattgttgtatcagtcaatggccctgccattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcacgggaggcatgcgccaaaggcctggtctctcaggtatttttgactggaactttcacccaagaggttatgattcaaattaaggagcttgcctcatacaatgcaattgtactggaagaatgtaaggccctcgttcgctgtaatattaagttggagttggaacaggccaatgagagagagtgtgaggtgctgaggaagatctggagctcagcccaagggatagaatccatgttaaagtatgttgaaaataaaattgatgagttttaattgtca

SEQ ID NO: 1068 - DNA, 2369 bp, Homo sapiens
aacaggcaggaagaaagctttctgtactacaccagagggttggggctgtggatttagctactctcacctgaggctactgagcaagctgtcatgcaccatgagacaaagcccaagctgtcccaccaggcagtaagtgtggagaggttcaggcacatggcatagctgctatttcgcacaattttcactacaccagtggtgaccaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaactccagtgactgataaacaccacaggtccaaaaactgcaagttatttgctgccagcaagaacgttaggagaaaggcagcttcaactctctccgacacaaagaatatggagataataaattcaactattgagacccttgcacctgacagcccctttgaccacaagaaaactgtgagtggctttcagaaacttgagaaactggaccctattgcagcagatcagcaggacacggtggtcttcaaggtgacagaagggaaactcctccgggaccctttgtcacatcctggtgcagaacagactggaatacagaacaagactcagatgcacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagaggccagccttttatcaagaagatgcacttcaccataaggctaacagaaagtgccatcacatacagagacattgtagtgaagaaagaggatggattcacccagatagtgctatcaactagatcgacagaaaaaaatgcactgaatacagaagtaattaaagaaatggttaatgctctgaatagcgctgctgcagatgacagcaagctcgtgctgttcagtgcagctggaagtgtcttttgctgcggtcttgattttgggtactttgtgaggcacttaaggaatgacagaaacacagcaagccttgaaatggtggacaccatcaagaactttgtgaatacttttattcaatttaaaaagcctattgttgtatcagtcaatggccctgccattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcacgggaggcatgcgccaaaggcctggtctctcaggtatttttgactggaactttcacccaagaggttatgattcaaattaaggagcttgcctcatacaatgcaattgtactggaagaatgtaaggccctcgttcgctgtaatattaagttggagttggaacaggccaatgagagagagtgtgaggtgctgaggaagatctggagctcagcccaagggatagaatccatgttaaaaatacctctattgggatataaagcagccttccctcccagaaagacacagaacgatcagagatggtgcccttgactttatagtggcacaaacacttcagagacacacaattataagagacttatcttttagcataaatacttatggcacaaaatccactgacgatcattctcctaaactgaacacatgactagaattggtggtgagatatcgcttgattttcttttcctttataaatgtctagttcttacccagttaacaaaagaaaactttatcgctctaaagtaaaacttgttacaccacattagtgaattatggaatcattttggtggaaatatccaggttctaatgtgtggaatgtgcagatttaggttactttagtgtatgttctagttaataagttaaaattctggacacattattaaaggcagaaacttctttcaaaacaaa

SEQ ID NO: 1069 - DNA, 3000 bp, Homo sapiens
cggaggcggagcaggcgccatgtcagcccgggaagtggccgtgctgctgctgtggctgagctgctatggctccgccctttggagattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcgggatggaatcgtttttcttataaatggtgttctttacataaagagttttcgtggatttataagactgggaggaattgtaaatcttcctgatggtggaattactggcatttcatcaagaaaatggtgttgggtcaattatttattaaaggctaaaggaagaagaagcacctttgcagtctggacagaaaatgaaatttacctcggatccattcttcttaagtttgccagattagtaactaccacagaactgaaaaacatcctaagtctatcggtgactgctactctgaccatagacagggttgagtatacaggacaccctctggagattgctgtgtttttaaattattgcactgtatgtaacgtcaccaaaaagattttcttagtgatatataatgaagatacaaaacagtgggtttcccaagactttacattagatgcccctattgacagtgttaccatgccacattttacattttcagcactgccaggattactgctatggaacaagcatagtatctactattgttaccataatttcacctttactgggattttacagacacctgcaggacatggaaatctatcaatgctatcaaatgacagcattattcatgaagttttcatagattattatggagatattttggtaaaaatggaaaataatgtaatattttattccaagattaatactagagatgcagtaaagctgcatttatggacaaattacacaacaagagcattcattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacaagacaagcacacgggtcttgtgctggttcagtttcgacctagtgaatattcaaaagcatgtccaatagcccaaaaggtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagaactataaacactgtttttcttatgctattggaaaaccaggagacttaaatcaaccatacgagattatcaacagttctaatggtaaccatatattttggcccatgggccattctggaatgtatgtatttcgtgtgaagatcctggatccaaactatagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattac

SEQ ID NO: 1070 - DNA, 3019 bp, Homo sapiens
cgggagtggccgaggcggttgggcggaggcggagcaggcgccatgtcagcccgggaagtggccgtgctgctgctgtggctgagctgctatggctccgccctttggaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagacatttctttaacaactttacccagcttatcactgtgtgggcatatgatccagaaagtgcagatcctgatgagttgctggggaatgcagaagaaccttcaataaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcgggatggaatcgtttttcttataaatggtgttctttacataaagagttttcgtggatttataagactgggaggaattgtaaatcttcctgatggtggaattactggcatttcatcaagaaaatggtgttgggtcaattatttattaaaggctaaaggaagaagaagcacctttgcagtctggacagaaaatgaaatttacctcggatccattcttcttaagtttgccagattagtaactaccacagaactgaaaaacatcctaagtctatcggtgactgctactctgaccatagacagggttgagtatacaggacaccctctggagattgctgtgtttttaaattattgcactgtatgtaacgtcaccaaaaagattttcttagtgatatataatgaagatacaaaacagtgggtttcccaagactttacattagatgcccctattgacagtgttaccatgccacattttacattttcagcactgccaggattactgctatggaacaagcatagtatctactattgttaccataatttcacctttactgggattttacagacacctgcaggacatggaaatctatcaatgctatcaaatgacagcattattcatgaagttttcatagattattatggagatattttggtaaaaatggaaaataatgtaatattttattccaagattaatactagagatgcagtaaagctgcatttatggacaaattacacaacaagagcattcattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacaagacaagcacacgggtcttgtgctggttcagtttcgacctagtgaatattcaaaagcatgtccaatagcccaaaaggtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattacaa

SEQ ID NO: 1071 - DNA, 3333 bp, Homo sapiens
gcgaggcctggacgggagtggccgaggcggttgggcggaggcggagcaggcgccatgtcagcccgggaagtggccgtgctgctgctgtggctgagctgctatggctccgccctttggaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagacatttctttaacaactttacccagcttatcactgtgtgggcatatgatccagaaagtgcagatcctgatgagttgctggggaatgcagaagaaccttcaataaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcgggatggaatcgtttttcttataaatggtgttctttacataaagagttttcgtggatttataagactgggaggaattgtaaatcttcctgatggtggaattactggcatttcatcaagaaaatggtgttgggtcaattatttattaaaggctaaaggaagaagaagcacctttgcagtctggacagaaaatgaaatttacctcggatccattcttcttaagtttgccagattagtaactaccacagaactgaaaaacatcctaagtctatcggtgactgctactctgaccatagacagggttgagtatacaggacaccctctggagattgctgtgtttttaaattattgcactgtatgtaacgtcaccaaaaagattttcttagtgatatataatgaagatacaaaacagtgggtttcccaagactttacattagatgcccctattgacagtgttaccatgccacattttacattttcagcactgccaggattactgctatggaacaagcatagtatctactattgttaccataatttcacctttactgggattttacagacacctgcaggacatggaaatctatcaatgctatcaaatgacagcattattcatgaagttttcatagattattatggagatattttggtaaaaatggaaaataatgtaatattttattccaagattaatactagagatgcagtaaagctgcatttatggacaaattacacaacaagagcattcattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacaagacaagcacacgggtcttgtgctggttcagtttcgacctagtgaatattcaaaagcatgtccaatagcccaaaaggtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagaactataaacactgtttttcttatgctattggaaaaccaggagacttaaatcaaccatacgagattatcaacagttctaatggtaaccatatattttggcccatgggccattctggaatgtatgtatttcgtgtgaagatcctggatccaaactatagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattacaatcctttgtaagaatgaaagtgaatttttgaaaatatatctatgtgtcaagtatcattttgcatgaaacttttcacatgaaaccttatatgactgtagttaatttatatataaaggatttaataaaggtgtgtggatttaaataa

SEQ ID NO: 1072 - DNA, 2555 bp, Homo sapiens
aatgcgcgaggcctggacgggagtggccgaggcggttgggcggaggcggagcaggcgccatgtcagcccgggaagtggccgtgctgctgctgtggctgagctgctatggctccgccctttggaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagacatttctttaacaactttacccagcttatcactgtgtgggcatatgatccagaaagtgcagatcctgatgagttgctggggaatgcagaagaaccttcaataaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcgggatggaatcgtttttcttataaatggtgttctttacataaagagttttcgtggatttataagactgggaggaattgtaaatcttcctgatggtggaattactggcatttcatcaagaaaatggtgttgggtcaattatttattaaaggctaaaggaagaagaagcacctttgcagtctggacagaaaatgaaatttacctcggatccattcttcttaagtttgccagattagtaactaccacagaactgaaaaacatcctaagtctatcggtgactgctactctgaccatagacagggttgagtatacaggacaccctctggagattgctgtgtttttaaattattgcactgtatgtaacgtcaccaaaaagattttcttagtgatatataatgaagatacaaaacagtgggtttcccaagactttacattagatgcccctattgacagtgttaccatgccacattttacattttcagcactgccaggattactgctatggaacaagcatagtatctactattgttaccataatttcacctttactgggattttacagacacctgcaggacatggaaatctatcaatgctatcaaatgacagcattattcatgaagttttcatagattattatggagatattttggtaaaaatggaaaataatgtaatattttattccaagattaatactagagatgcagtaaagctgcatttatggacaaattacacaacaagagcattcattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacaagacaagcacacgggtcttgtgctggttcagtttcgacctagtgaatattcaaaagcatgtccaatagcccaaaaggtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagtttctg

SEQ ID NO: 1073 - DNA, 2895 bp, Homo sapiens
cggaggcggagcaggcgccatgtcagcccgggaagtggccgtgctgctgctgtggctgagctgctatggctccgccctttggagattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttaggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcgggatggaatcgtttttcttataaatggtgttctttacataaagagttttcgtggatttataagactgggaggaattgtaaatcttcctgatggtggaattactggcatttcatcaagaaaatggtgttgggtcaattatttattaaaggctaaaggaagaagaagcacctttgcagtctggacagaaaatgaaatttacctcggatccattcttcttaagtttgccagattagtaactaccacagaactgaaaaacatcctaagtctatcggtgactgctactctgaccatagacagggttgagtatacaggacaccctctggagattgctgtgtttttaaattattgcactgtatgtaacgtcaccaaaaagattttcttagtgatatataatgaagatacaaaacagtgggtttcccaagactttacattagatgcccctattgacagtgttaccatgccacattttacattttcagcactgccaggattactgctatggaacaagcatagtatctactattgttaccataatttcacctttactgggattttacagacacctgcaggacatggaaatctatcaatgctatcaaatgacagcattattcatgaagttttcatagattattatggagatattttggtaaaaatggaaaataatgtaatattttattccaagattaatactagagatgcagtaaagctgcatttatggacaaattacacaacaagagcattcattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacaagacaagcacacgggtcttgtgctggttcagtttcgacctagtgaatattcaaaagcatgtccaatagcccaaaaggtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagaactataaacactgtttttcttatgctattggaaaaccaggagacttaaatcaaccatacgagattatcaacagttctaatggtaaccatatattttggcccatgggccattctggaatgtatgtatttcgtgtgaagatcctggatccaaactatagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagagtgtgtgtttgaccaagaaatactaaatataagctcgtagtaggcatcaccaaattcaagatctgaaaaatattcttgaactatctccaaaatagaaatgttttcatatatattgttattaaattaatcctttgtttgccttcattttaaagatactctatgtactctcacatggcatgaaaaaataaactaaatttgactattacaa

SEQ ID NO: 1074 - DNA, 3953 bp, Homo sapiens
gaccctggctgggagcgcggcggtgccggcgggaggccgagcggggctcgacagagcaggatcgagatgaccacagccacccctctgggggataccaccttcttctcactgaacatgaccaccaggggagaagacttcctgtataagagttctggagccattgttgctgccgttgtggtggttgtcatcatcatcttcaccgtggttctgatcctgctgaagatgtacaacaggaaaatgaggacgaggcgggaactagagcccaagggccccaagccaaccgccccttctgccgtgggcccaaacagcaacggcagccaacacccagcaactgtgaccttcagtcctgttgacgtccaggtggagacgcgatgacctctaccctggcgctatctccaccactgtccaaagagcctctccagagtcaagacccagaggcacactctctggcagcttcacaatgagcttcttctggtcaggtcgacagagacatctttgacgcaatctctgatgcttccagcaatcctcaaccttgtctgccctgccctaccccaactgtgtccacatccctgccgccaccccaccaaaaagctgcagaacattcttttgtcatctgatgaggtagagctatgttgggaatccaccaatgtgggcttggctttcccccacactgtagttagacagatagacagatagcccaggagccaggtgtcagggagcactgctgagagtatcacaataggatctgtcacggggttcatatcagatgaagcgccgtatccactgcttcacagagcaaaacattcaatcccataaccaggcacaggggaactaacttggactaactaaccagaaaaccttgttaacgtataacttgttccagtactacatctctgcctgctggctcatgacaattgctcagcacattttcccctcttgaagaaaggttgcaagaagaactaaattatcctcaaaagatttctgcttcattagtaaagagtcagtgatggaatagggtgactctgcagaatagtggcctctagggtaggagcttgttgtgttgtccgtgggcctggaatgatcctggtggctgatcagggtccttctcccactctgggctgtatcaaccctgacggtcttggtctttggctcccctttatctggattctgagcacgctgactgtcctgttaatgccttccctccaaggaccagtatttggagattaattagattacaactctatctatgttacctttgtccttcctggtcaccttgcagattcaagacatgttcaaagcaacacattcacaacccatttctattctatagcaacctcgtctgtgactccttagcctggagaacaatctaccaagaagagaaagtatctggaattaagaagtcctaccatccaagccctacttcctggttgtgtggccttggaaaagtgactcaacctctttatattcagtttcctaaccatgaagtggaaatgataacacctgcctcattggggcactataacaagtgaaggacttaggaaaacatctggagtatagcgcctggcacccaggagatgcttaataaatgggaaccaggattctttttcttttcttttttcttttcttttttttttttttttgagacagagcctcaatctgtcacctgggctggagtgcagtggcacgctcacagctcgctgcagccttgaactcctgggctcaagggatgctccctcctcagcctccagagtagctgggactacaggtatgtgtcacctcaccaggctaatttttttattttttatttttgtagagatggggtctcgctgtgttgcccaggctggtcttgaacccctggcctcaagtgatccttctgctttggcctcccaaagtgctgggattacaggcatggactatggtgcccagcctaggagccaacattattattattataggcttttttttcaattgcaagatagacatttcttcacattttaatgattctgaaatcagaacatatcttgcaattgatgggttcattaatataattgtagttctttacttcctctcaaaaacttgtgatcttataattgatggcatcttggaaacaaggtaataaatctctattctgttaaagaaagtgacacactttgacatttaacctcaaattttaggagtctctccctcttggggtcagaaatcccttctgaggccaggtgtcgtggctcatgcctgtaatcccagcactttgggaggctgaggcaggcgggtcacttgaggtcaggagtttgagaccagcctggccaacatggcaaaaccctgtctctactaataatacaaaatttagctgggcatggtggcatgcacctgtaatcccactactagggaggctgtggcatgagaatcacttgaacctggaaggcagaggttgcagtgagccaagatcgtgccactgcactccagcctgggcaacagagtgaaactgcatctcaaaaaaagaaaaatccattatgaggggaaatcaagagtcagggaggtaagaggtcttacccagggtcacacagctcatgatatcccactgtaaaaatactctgtggaatagctctggagaaatactggcacattcttcctctctggtcattatttcttcctactgtgtttaaatatccaccaagtgtcaaggactttgtaagatgctttcacataaattatctcataggattaaattttcccaaaaacctggggaggaattattttttccaaaacagatgataatttctgattcaaagagaaagaaaacaaagtacttttccaaagtcacacagctagtaagtcacaaagacaagactcaaaaccaggtctcttgactccaaagtctgtcttttttgtgaagtcacactcctctgctggcccagctcaaagcagcacagattctttatgggctgaacaaggggagtacgggtttgtccatgtgtttgagtagagatcagggttctggcttccaggctgaaggtgagggaaaagccacttctaactcctttgggcatccatgctcacggccaaaagagccccttctcaacacatccaagtgctaaggattcctgcttcattcaagctactacttaggcccaaggagcaaggggtagaatggcatctaaccagagcaaagccatttctttgagggctcaagccataaacaaatatgctcccctaaacatattcggcttgaaaaagttgttttggggcagctgtggtggtgcacccctgtaatcccagccctttgggagtcagaggcagtcagtcacttgagcccaggagttcaagactagcctgggcaacacggcgaaacctcgtctctacaaaaaatacaaaaattaaccaagcgtggtagtgcacgcctgtattcccagctacttgggaggctgaggtaggaggatggcttgagcctgggaggcagaggttgcagtgagctgagatcgcgccactgcactccagccggggtgacagagccagaccctgtctcaaagcatatttcaaccctaaaactagactcttctgcccacagtgcagtcttctaagggttaccctctggtatatgttcttttgctaaatgaaggcttggagttggagggaagaaggggagatggagtggtgagggcgagtcaaataaaaggatttgagtgtctcgtttttgactaatgaagatgattcaataaacatcctgtaagaagggttcctatgtgcaagttgaggtgctactaagtacattaagacacaattgctgctctcaaggagttagcagctggtctcatgcagggatctcaccacgtggttatgtattttgtttctgatgaggtgcctttcttagcagatgctgccttatttggccactgaaacaatcaaagctaataaatgcttaaagaaaaatatctgacaataaaaaggtttaaatc

SEQ ID NO: 1075 - DNA, 2542 bp, Homo sapiens
gaatccgggggaatgtagtccctccgtgtcagggacccgagacatgcgctggttcttctaggactacatttcccagggcgcttcgcgccccgccccggcgccccacccacggccgcgcgcgatggtaccaccaggcgagggcggctctcgcgcgggccgccgggagttgtagttttctttgggagctgcggggcctggcgccggggccggggcggaagaaagactacaagtcccagggggcgcggcgccaccgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcaggtaacagcagctgtcgcatccccctgtggggtttcccatctctgggccagtcccagggtgctctgtgggtttgtccccaaacgggtttgcctggctctggatctcggccacccctgcccgggtccccaggagacccacccacaaggcagggccagggccggatttggctggtgccccctgctctggatctcagctggatttggccggcgccccctgcccgcccccctttaatccccgtgacttccatgctctttcctgttcccgagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccctctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 1076 - DNA, 1097 bp, Homo sapiens
ggtagagggatcaagttgtcttcaattttatctcctctgctgactttttagttctgcctctttgtgttgttttttaagtggttcctctggagattaaatgtacttcacagaacctcagcgagcggactccagttatattccgtgctcttgtcggcacgcatttcacttctaggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccacca

SEQ ID NO: 1077 - DNA, 2429 bp, Homo sapiens
gagaaacccggagggcgccgggtattaccagggtgtgcagagaaggcagagctgcgtcttcctcttttatttttccgactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggtcacgagaaacagcacagctgtgatcaacacacaagctgagggtaccctgagccccccaggcctgtccagtctgcctgtggtcagggaatgggccctcacacacaccgcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcaggtaacagcagctgtcgcatccccctgtggggtttcccatctctgggccagtcccagggtgctctgtgggtttgtccccaaacgggtttgcctggctctggatctcggccacccctgcccgggtccccaggagacccacccacaaggcagggccagggccggatttggctggtgccccctgctctggatctcagctggatttggccggcgccccctgcccgcccccctttaatccccgtgacttccatgctctttcctgttcccgagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccctctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 1078 - DNA, 1841 bp, Homo sapiens
gggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccctctgaggggtggcctggccttcggggtccccacgctcctttgcgaagtccactgtgggtgccatcatggtctccgggacctgggccagcgggaacgtgggggcactgggtgtgctgatataaagtcggcattactcaa

SEQ ID NO: 1079 - DNA, 990 bp, Homo sapiens
gaatccgggggaatgtagtccctccgtgtcagggacccgagacatgcgctggttcttctaggactacatttcccagggcgcttcgcgccccgccccggcgccccacccacggccgcgcgcgatggtaccaccaggcgagggcggctctcgcgcgggccgccgggagttgtagttttctttgggagctgcggggcctggcgccggggccggggcggaagaaagactacaagtcccagggggcgcggcgccaccgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagggccggcccccgcagggtccctgccaggcagatggtccagccagcagttcggaccccaagctccggccctgcagcctggcgaagccgtaagtaacccacatcatccgggctga

SEQ ID NO: 1080 - DNA, 554 bp, Homo sapiens
gagtcctccggcaggctcacacctgggcagcctggtcagtttgtgaggccatgacctgaatccagcatggaatgggtgacagagtggaccgtccctgtgcggagagtggaccgtccctgtgcagagactggagctgtgtcctccagggcctccgtctccctgctgctcacagcccttgtcccaggaccccggcctaggcccatcaagaggagccccacaggcctggctgggcctcagcccccctcggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcg

SEQ ID NO: 1081 - DNA, 2650 bp, Homo sapiens
gaatccgggggaatgtagtccctccgtgtcagggacccgagacatgcgctggttcttctaggactacatttcccagggcgcttcgcgccccgccccggcgccccacccacggccgcgcgcgatggtaccaccaggcgagggcggctctcgcgcgggccgccgggagttgtagttttctttgggagctgcggggcctggcgccggggccggggcggaagaaagactacaagtcccagggggcgcggcgccaccgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggtcacgagaaacagcacagctgtgatcaacacacaagctgagggtaccctgagccccccaggcctgtccagtctgcctgtggtcagggaatgggccctcacacacaccgcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcaggtaacagcagctgtcgcatccccctgtggggtttcccatctctgggccagtcccagggtgctctgtgggtttgtccccaaacgggtttgcctggctctggatctcggccacccctgcccgggtccccaggagacccacccacaaggcagggccagggccggatttggctggtgccccctgctctggatctcagctggatttggccggcgccccctgcccgcccccctttaatccccgtgacttccatgctctttcctgttcccgagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccctctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 1082 - DNA, 983 bp, Homo sapiens
gaatccgggggaatgtagtccctccgtgtcagggacccgagacatgcgctggttcttctaggactacatttcccagggcgcttcgcgccccgccccggcgccccacccacggccgcgcgcgatggtaccaccaggcgagggcggctctcgcgcgggccgccgggagttgtagttttctttgggagctgcggggcctggcgccggggccggggcggaagaaagactacaagtcccagggggcgcggcgccaccgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctgctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctgtagttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagacgtggggtctgcaggaaaggaggacccaccacgacagggcagacccccaatacctgctcctccttga

SEQ ID NO: 1083 - DNA, 1107 bp, Homo sapiens
ctgggccacagagcgagactccgtctcaaaaaataaaataaatcataatgttgacctcaaagaggaagcctaccgttgagtttagtaagatctttgctacacacaatgtgatgctggcagtggcaggggcagtaatctttatttcgtcatttttgaaacatagaagccgtaacggaagcaagtgaaatgctcagtcttagacgactgcgtcgtgctatgaccggactttttcttgaaaggggatgacagcatgggaggcaatggctccacatgtaaacccgacactgaaagacaaggcactctctccacagcagccccaacaactagccctgcaccctgtctctctaaccaccacaacaaaaaacatttaatccttgccttttgtgctggggttctactgacactgctgctgatagcctttatcttcctcatcataaagagctacagaaaatatcgaagggagaggcttcccatttccccaggcccattgctgagatgggtccctcttctttctggcaccatggcagatcactccaagccccaggccccagatcctcactcagatcctccagccaagctttcatccatcccaggggaatcacttacctatgccagcacaactttcaaactctcagaagaaaagagcaatcacttggctgagaaccattctgcagactttgaccccattgtctatgctcaaattaaagtaacaaactaactcagcttttccaatgaggcttgaatccatttcctctcatctcagccctatcttcacacatcactttcacttttttacaaattttggaccaccacctgtgtgaaactgcagtcggagttgtttagatgtgatctggcaatgctatccagcatctttggagaccaatggtcagtcttttcctggccagaggaaagattgatggccctcccacttgaactgacagcctgtgagccccttgggggcatagactgccttccttggacccttccaaagtgtgtggtacagagctcagtgcacagagtattcacccagcatcatgaatcaacttgggaggagtcaaccaaatgaacaatctaccaaaaatttcaaataaagtcaaaccccccaca

SEQ ID NO: 1084 - DNA, 915 bp, Homo sapiens
gagtttagtaagatctttgctacacacaatgtgatgctggcagtggcaggggcagtaatctttatttcgtcatttttgaaacatagaagccgtaacggaagcaagtgaaatgctcagtcttagacgactgcgtcgtgctatgaccggactttttcttgaaaggggatgacagcatgggaggcaatggctccacatgtaaacccgacactgaaagacaaggcactctctccacagcagccccaacaactagccctgcaccctgtctctctaaccaccacaacaaaaaacatttaatccttgccttttgtgctggggttctactgacactgctgctgatagcctttatcttcctcatcataaagagctacagaaaatatcactccaagccccaggccccagatcctcactcagatcctccagccaagctttcatccatcccaggggaatcacttacctatgccagcacaactttcaaactctcagaagaaaagagcaatcacttggctgagaaccattctgcagactttgaccccattgtctatgctcaaattaaagtaacaaactaactcagcttttccaatgaggcttgaatccatttcctctcatctcagccctatcttcacacatcactttcacttttttacaaattttggaccaccacctgtgtgaaactgcagtcggagttgtttagatgtgatctggcaatgctatccagcatctttggagaccaatggtcagtcttttcctggccagaggaaagattgatggccctcccacttgaactgacagcctgtgagccccttgggggcatagactgccttccttggacccttccaaagtgtgtggtacagagctcagtgcacagagtattcacccagcatcatgaatcaacttgggaggagtcaaccaaatgaa

SEQ ID NO: 1085 - DNA, 909 bp, Homo sapiens
atggcttcacctaaaggtttttttaattacttgacctattttcttgctgctggtgctgtcactttgggaattggtttctttgctttggcatcagctttgtggttcctgatttgcaaacgaagagaaatatttcaaaattccaaatttaaagcaattgatgagagatgcaggcaaagaccatcaatggcgaagattaaatctcattctcagtgtgtttttatttctcgaaattttcatactgggagattccaattacaggaggagcaaagaaaaaaggaagcagcacatataaaagcaattaaagatcattctaaagatgaaccccaacttgcaacaaaaaatatcatttgtgatccctcagagaccagctccacaacaaatcgcagcagtgttacattaagcttatcaacattaccatctgattcttattacagccaaagtatagaagcagctgatgactggttttctgatgattctctagtgaaaaggaactctccaatgccttctctcggggaacctctaatggaaaaagtattttcatacctgtcaaccatttcattagaagagggtactgaaagtgtactgaatgacactttatgaccatcaaaaagatgactacattaagggaaaatgttcatgaagaaacacagaggttgaaatataaaaccttcaacataatactgaatgacttttttcttttgaaaccttgtatacaatcagcttctgagtctcttaacatgtccatgctaatattgctttttttgttctttaccatagagcggctctacttcccttgctggttcttatttctagaaacaaaattaggaagaactagagtgatgtcatgaacattaagcttaacttattgtatctcatccaaagacatattaaataaaatgagtgtatgtc

SEQ ID NO: 1086 - DNA, 1665 bp, Homo sapiens
attgtatagaagaacattgtgaaactccctgccctgttctgtttctctctgaccaccggtgcatgcagcccctgtcacataccgcctgcttgctcaaatcaatcatgaccctttcatgtgaaatctttagtattgtgagcccttaaaagggacggaaattgtgcattcggggagctcggattttaaggcagtagcctgctgatgctcccagctgaataaagcccttccttctacaatttggtgtctgaggggttttgtctgcggctcgtcctgctacatttcttggttccctgaccaggaaacgaggtaactgatggacagccgaggcagccccttaggcggcttaggcctcccctgtggagcatccctgaggcggactccggccagcccgagtgacgcgatccaaagagcactcccgggtaggaaattgccccggtggaatgcctcaccagagcagcgtgtagcagttccctgtggaggattaacacagtggctgaacaccgggaaggaactggcacttggagtccggacatctgaaacttgatctccagcaccctgccggtggcactactgagagacgaggtgccagggtggttcctgaaagtgcctgagccccaacttatcagcaaggagctcatcatgctgacagaagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtgaattccaaatatttttaatggggtccagttctctatggattcttacatttaatttgtagggaaatgccatttttcccccttaaacaaggcatggggctcacaagtctatggagacaggccaaaaagaatgtggagaagaaaactgataaatacacagaggtcctcaagacccatggactcctggtctgtacccaaaaaagctgttcgttcctcaaaaacaaaaacaaggcttggctgggaaaacaggccaatgccccggcaagaaaggttgagatcagatgttaggaagaactttcaggtaaagtatgagaactatggagtccatcagcagagatagtagtgaagtctctccccagggaaaattttaaaaaggttgaatcagctgttgtagagttctatttggcaatctcatggttaaatgacttccctttgagctctttaattattggcaataaacaacttctttaaaagttttaaataaaatagcaaccaccaccagttcctcttt

SEQ ID NO: 1087 - DNA, 629 bp, Homo sapiens
acctgtccaggttctgccggccccagccggaagcttactccgcggattgtgcacagttcttgaaggacttgtgccctggggctgcctggcatctgggggcctcctcagagccagggctctttctggttgaggctgagactcactggtgtcatcaggcccctccatgaatgagacaaacaaaacacttgttgggccttcggagctccccacagcgtctgctgtggcccctggcccaggcactggggctcgggcatggcctgtgctggtaggatttgtgctgggggctgtggtcctctcgctcctcattgcacttgctgccaaatgccacctctgccgccgataccatgccagctaccggcaccgcccactgcctgagacaggaaggggaggccgcccacaggtggctgaagatgaggatgatgatggcttcatcgaggacaattacattcagcctgggactggcgagctggggacagagggtagcagggaccacttctccctctgagctcccatctttagaccctccccactccctccatgcctgacagcttaaggacagtggttatgacatgggggccttgaacctcagggacagaggtggctggggcttaaaggttggccagggatgg

SEQ ID NO: 1088 - DNA, 1478 bp, Homo sapiens
tccgcggattgtgcacagttcttgaaggtgggaacagaagagaaggcccgggggggccggggagggggtacccaggctctgcacagtacccaaggggcttctggcagcaggaaggaagctacacatcagagttggggacttgtgccctggggctgcctggcatctgggggcctcctcagagccagggctctttctggttgaggctgagactcactggtgtcatcaggcccctccatgaatgagacaaacaaaacacttgttgggccttcggagctccccacagcgtctgctgtggcccctggcccaggcactggggctcgggcatggcctgtgctggtaggatttgtgctgggggctgtggtcctctcgctcctcattgcacttgctgccaaatgccacctctgccgccgataccatgccagctaccggcaccgcccactgcctgagacaggaaggggaggccgcccacaggtggctgaagatgaggatgatgatggcttcatcgaggacaattacattcagcctgggactggcgagctggggacagagggtagcagggaccacttctccctctgagctcccatctttagaccctccccactccctccatgcctgacagcttaaggacagtggttatgacatgggggccttgaacctcagggacagaggtggctggggcttaaaggttggccagggatggagtaaaccccacttccctgacactagccagcaaagtgacaatgaccctctcttgctcaataactctcaactgttccctgctgttctcaggataaagccaaacaaaggcttgagtgtggacataaggccctctgtgatcatgcctctcggcctcttggtttcttttcttgccttcccctactttactgtcgaaatcaatgttattctccctcccaccacttcccatgcagtttccccaggcacctttgctcacattggtccccctgcctacgctactcttctcctaaatcctctatgactgtgatggcctgcctacctgccagcatttcaaatatgcccagatggtaacatttgtgcaggtgaaaaccagtgccaagcttcctttttttttttttcctgagacggagtctcactctgttgcccaggctggagtgcaatggcacatcttggctcactgcaacctccgcctcctgggttcaagcgattctcctgcttcagcctcctgagtagctgggattacaggcatccgccaccacgcccagctaatttttatatttttagtagagacgaggtttcgccatattggccaggatggtctcgaactcttgacctcaggtagtccgccttcctcggcctcccaaagtgctgggattacaggcgtgagccaccatgcccggccagcttcttaatgaaatattttcctataaataaagtgggtaatccggttataatatgtttttcacaggaattaataaatctattttcattttgaataaaaa

SEQ ID NO: 1089 - DNA, 3820 bp, Homo sapiens
gatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaaattcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgcaacattaa

SEQ ID NO: 1090 - DNA, 3823 bp, Homo sapiens
cgtcatcaatctgcgccacctgactcccaagtccctggctttggagtgggaagtgaggtgtgggaagtaggtcgctttctgatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaaattcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgc

SEQ ID NO: 1091 - DNA, 3796 bp, Homo sapiens
cgtcatcaatctgcgccacctgactcccaagtccctggctttggagtgggaagtgaggtgtgggaagtaggtcgctttctgatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccagctaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaaattcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgc

SEQ ID NO: 1092 - DNA, 1241 bp, Homo sapiens
cgtcatcaatctgcgccacctgactcccaagtccctggctttggagtgggaagtgaggtgtgggaagtaggtcgctttctgatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagatttt

SEQ ID NO: 1093 - DNA, 1013 bp, Homo sapiens
gtggggcgcgcgtggactatgggcccgggaggtcccttactgtccccgagccgcgggttcctcttgtgcaaaacggggtggcactccaatcgcctgcttggtgattgtggcccccacacacctgtttctacagcgcttaggttcgaacagtaaccctgtaaactaggcactgctgtccccgctttactggtgggaaacgggctcggagagaataaatgagctgccctaagcgactgggacagaaccacagttctcagccgggctttctgagcccacgctgccgccccagcagggatcaaatcacacagtgtgagataagcctcaagagcgggtggccttatgctgccactgagaactgattgggttcagttgcctcatcaaaatccctaagcatggttttgttttgtttttgtttttttttttttttttagttttaaaggaagaggagattgacggttttcctctttccttatcttctcttcagattacaaagttcattgttaatctcaaatattattttggccaacagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacacat

SEQ ID NO: 1094 - DNA, 641 bp, Homo sapiens
gcttgctgatgggtccgggtggggcgcgcgtggactatgggcccgggaggtcccttactgtccccgagccgcgggttcctcttgtgcaaaacggggtggcactccaatcgcctgcttggtgattgtggcccccacacacctgtttctacagcgcttagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacaca

SEQ ID NO: 1095 - DNA, 710 bp, Homo sapiens
atggaaagtaaatggtagctcggaagggtcaaaagagtccgcggtttcgccgcgtgagttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacacatgca

SEQ ID NO: 1096 - DNA, 700 bp, Homo sapiens
atggtagctcggaagggtcaaaagagtccgcggtttcgccgcgtgagttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacacatg

SEQ ID NO: 1097 - DNA, 1610 bp, Homo sapiens
gtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaa

SEQ ID NO: 1098 - DNA, 1551 bp, Homo sapiens
gtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaa

SEQ ID NO: 1099 - DNA, 872 bp, Homo sapiens
ctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcct

SEQ ID NO: 1100 - DNA, 1278 bp, Homo sapiens
cttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcctataatcccagcactttgggaggccgaggcgggaggatcatctgaggttgggaatccgagaccagcctgaccaacatggagaaaccccgttctctactaaaaatacaaaattagccgggcgtggtggcgcatgcctgtaatcctagcttctggggaggctgaggcaggagaatctcttgaacccgggaggcggaggttgcggtgagccaagatcgtgccattatactccagcctgggcaacaaaagtgaaactctgtctcaaaaaaaaaaaagaagaaaagaaagcagatgcaactatacaagctagtaaaagaagtttttactagcatttttcttgtgtgcatttttcttgtcttttgtttagcccaataaaatgtcaaaattggtgtagcctagcaaa

SEQ ID NO: 1101 - DNA, 1163 bp, Homo sapiens
ttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaa

SEQ ID NO: 1102 - DNA, 1694 bp, Homo sapiens
gctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaa

SEQ ID NO: 1103 - DNA, 1604 bp, Homo sapiens
ctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacaggg

SEQ ID NO: 1104 - DNA, 5556 bp, Homo sapiens
ccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaaggatgaaagagagggacctatcaatgccgaatcattgggaaaatcaggttcaaatttacctatttctccaaaagaacataaattaaaagatgattctattgtggatgtacaaaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaagatgttcatcaagtacataaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttatt

SEQ ID NO: 1105 - DNA, 5917 bp, Homo sapiens
cccaaagttcgaaaccaacagaacgaaaagcaacgaagcacacttaaagtgaggaacccggcaagcggcgaaattcttgctgaagagaagaaaaagcgaaaggttttccgctgcaaccaatcagatgagaggattcttggcacgcccctttctatctaccaatcaacatctagctcaatggggcagtccattgccacagggaaagggcttggtgcagcttccctcacaacacacacgtcattctaggccattccacgaactgtgctcaaaagaggaaaacagtgcaacagttccaaagctgatcagtctcgtggtgagcagcgaaactatagacttctctaacaaaaccatggattctaggagggactgggaaagagaaaaacgaattctggaaggcaaactacaactcccaaaggcccttgcgcggactcagcgcgcgagggacgaagggcggcgggcgtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaagaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttatt

SEQ ID NO: 1106 - DNA, 2136 bp, Homo sapiens
acagctggggagccagcccggtggccctgggcgggcgaatctcctcagaatcgcgggcctggtccccacccccaacacgcttgtatgcccgcccctcccgacgccgccttgctgggtgccaagaaccaaccgaagcagccagaactcctcagtgaaaggcctgctttatgttcccggggcagtgaggagggggcttctcccttcccattgtccagactcagcccccgaaagagagggctcagccttcccaccagccctggagaggaggaagggactgactacgccagcaagctctggagctcagcagtggcaaagatgagatctccttgttggtggaacaggagttcctaagcctcaccaaagagcactcgatcctggtcgaagagagttctggggagctggaggtacccggcagctctcccgaggggaccagagagctggctccctgcattcttgcccctcctctagtggcaggcagtaatgagcgccccagagcctccatcattgtcggagacaagcttctgaagcagaaggtggccatgcccgttatcagcagcaggcaggactgtgattctgccacttctactgtcacagacattctgtgtgccgccgaggtcaagagcagcaaggggacagaggacaggggccgcatcctaggtgactccaacttgcaagtcagcaagcttctgtcccagttcccactgaagtccactgagacatccaaggtccctgacaacaagaatgtgctggacaagacaagggtcaccaaggacttcctacaggacaacctgttcagtggccctggacccaaggagcccacagggctgagcccatttctgctgctgcctccccgacctcctcctgcacgtcctgacaagctccctgagctccctgctcagaagaggcagctcccagtgtttgccaagatctgttccaagcccaaggctgaccctgctgtggagaggcaccacttgatggaatggagccctggcaccaaggagccaaaaaagggtcaagggagcctctttctcagccagtggccccagagccagaaggacgcctgtggtgaggagggttgctgtgacgcagtgggcaccgcatcactgaccctgccgcccaagaaacctacatgtccagccgagaagaacttgctctatgagttccttggggccaccaagaacccaagcgggcagccgagacttcgaaacaaagtggaagtggatgggccggagctgaaatttaacgcacctgtgacggttgctgacaagaacaacccgaagtacacagggaatgttttcactccacactttcctacagccatgacctcagcaaccctgaaccagccactctggctcaacctgaactatccacctccaccagtgttcacgaatcactctaccttcttgcagtatcagggcctgtacccacagcaggcagcgaggatgccctatcagcaggctttgcacccgcagctgggatgttactcccaacaggtgatgccatacaacccacagcagatgggacagcagatcttccgctcttcctacacccctctgctgagctacatcccttttgtccagcccaattatccctaccctcagaggacacctccaaagatgtctgccaacccccgagaccctcccctaatggcaggagatggaccgcagtacctctttccccaaggatatgggttcggctcgacatccggagggcccttgatgcacagcccctatttttcttccagtgggaatggcataaacttttagatctcctcttctcccttctcctcccttagcccttggatcaggactaggggctctgatttttggattctgcaaaagcttggtatgaagtttggaaaagcaaggttctgaccaggtcacagacaaaacagcaagaccagattcatctattggccaacactgacacaaaaatagccctcctcacacatggcacaagctacacacacacacacacacatgaccctcatattcatacttgcttgctcaaccacttatgcatctatatttagctaacatgagtgatttttgtttttgtttttgttggtaaaatagaagtaagacacttaattttagaaagtttgtattttatgataaaagtatgagctacttgaaa

SEQ ID NO: 1107 - DNA, 2287 bp, Homo sapiens
ctccacccacccctcccacacaaatagaaggcctctgaacctaaccaccttgctggagcgaaagccagacagaactgacccacttctgccaagccccatcctcatctccctttctggtgaatgaggggtggtggtggttgtgttctagccctgggtggacagaggggcttccagaaagagaggaggaggatggccagcgggaatgggcttccttcatcctcggccctggtggccaagggcccctgcgccctgggcccattccccagatacatctggatccaccaggacacaccccaagacagcctagacaagacttgccatgaaatctggaagagagttcaaggcctgcctgaggcctcacagccctggacctccatggagcagctctctgtccctgtggttggaactctaagaggcaatgagctcagctttcaagaagaagctctggagctcagcagtggcaaagatgagatctccttgttggtggaacaggagttcctaagcctcaccaaagagcactcgatcctggtcgaagagagttctggggagctggaggtacccggcagctctcccgaggggaccagagagctggctccctgcattcttgcccctcctctagtggcaggcagtaatgagcgccccagagcctccatcattgtcggagacaagcttctgaagcagaaggtggccatgcccgttatcagcagcaggcaggactgtgattctgccacttctactgtcacagacattctgtgtgccgccgaggtcaagagcagcaaggggacagaggacaggggccgcatcctaggtgactccaacttgcaagtcagcaagcttctgtcccagttcccactgaagtccactgagacatccaaggtccctgacaacaagaatgtgctggacaagacaagggtcaccaaggacttcctacaggacaacctgttcagtggccctggacccaaggagcccacagggctgagcccatttctgctgctgcctccccgacctcctcctgcacgtcctgacaagctccctgagctccctgctcagaagaggcagctcccagtgtttgccaagatctgttccaagcccaaggctgaccctgctgtggagaggcaccacttgatggaatggagccctggcaccaaggagccaaaaaagggtcaagggagcctctttctcagccagtggccccagagccagaaggacgcctgtggtgaggagggttgctgtgacgcagtgggcaccgcatcactgaccctgccgcccaagaaacctacatgtccagccgagaagaacttgctctatgagttccttggggccaccaagaacccaagcgggcagccgagacttcgaaacaaagtggaagtggatgggccggagctgaaatttaacgcacctgtgacggttgctgacaagaacaacccgaagtacacagggaatgttttcactccacactttcctacagccatgacctcagcaaccctgaaccagccactctggctcaacctgaactatccacctccaccagtgttcacgaatcactctaccttcttgcagtatcagggcctgtacccacagcaggcagcgaggatgccctatcagcaggctttgcacccgcagctgggatgttactcccaacaggtgatgccatacaacccacagcagatgggacagcagatcttccgctcttcctacacccctctgctgagctacatcccttttgtccagcccaattatccctaccctcagaggacacctccaaagatgtctgccaacccccgagaccctcccctaatggcaggagatggaccgcagtacctctttccccaaggatatgggttcggctcgacatccggagggcccttgatgcacagcccctatttttcttccagtgggaatggcataaacttttagatctcctcttctcccttctcctcccttagcccttggatcaggactaggggctctgatttttggattctgcaaaagcttggtatgaagtttggaaaagcaaggttctgaccaggtcacagacaaaacagcaagaccagattcatctattggccaacactgacacaaaaatagccctcctcacacatggcacaagctacacacacacacacacacatgaccctcatattcatacttgcttgctcaaccacttatgcatctatatttagctaacatgagtgatttttgtttttgtttttgttggtaaaatagaagtaagacacttaattttagaaagtttgtattttatgataaaagtatgagctacttgaaa

SEQ ID NO: 1108 - DNA, 7705 bp, Homo sapiens
gagctcggcgcggagcccggagcccgcagccgacagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactggggacattcgtctcggccttcactgtgctgtgcggggcccgcaccgacctcccggacaggcatgtgtgctgcgtcttctggctgaacattgcagcagccctcatccaaatcctcactgccatcgtcatggtgggctggatcatgagcatcttctggggcatggacatggtcatccttgccatttcccaaggctacaaggagcagggcatcccacagcagctgtgagcccacgggagccgctggggagatccaggggggccctgtgagggctgcaccaggcagctttgggcacaaggacctttacatgttcttttctgccattttctggactgggggtggaaagggggtatttttaaaaatattatttattttgaaaacgcatctgcttttctcagcaggttgtgagggctgccagcccctcctgctctggaaagcactgtgggcgcaggcaccagagcatcagagagtggggtggagatgagaacgcccacagagaggctgggatgctccggcaggctccaactggccttgctgtacccactgcccaccgcaaaggcacgccacgtctgctgggccgggccacaccgggccctgtctgggtgagcaggggctcaccaaggggacaggactgtggtagacccgtcctgtgggaccccacctgcctcaaaatctggtgccccgagtgtttactgtgtggtctcctgggggcagcaccagggtgtgggtgaggatggccaggctccaccctagcgtggaaaggcccactgtgcccacagctggcctgaggcctcggggagaagaccagtcccacaggcgtctcctgggcctgcctccctgaccgcaccccccgcctcctcgcagctgaaatctgagggctgggtgtgtcgtgacctgtgttttcctgggaaggagaggagtagctccttccctggggtgaaactgccagatgtttatacacaaagttattagactgaagcaggagtgggcagactagcaggctttcacccaatacttaacagcatttctggcccacattcctttttctgaagtcattggggccagatgtgtctccgaattgagaaattttagatttgagaaagacaatgcgatccatttatcgtacactttctaacttcccggcagagtgtggaacatctcgcctaccatcaggcacgtgaatatttctgcagagaaacatgtgactagtcccattaactgggagctatacaaactgtaaatagcctcacctcagttcagtctaattttgccactaagtaacttagggaaaaacttaccatttgagagcttttagggtttcagaattgcaagaacaattgtatggggttgtggaccttgatctgaaaatcctgcttgcaaacagatgtgttagagggtgaaattgtcggcattacacaaggactccttcagttgccaaaagaccatgggcctctttaaggagcccctctgtaagtgattgggacagggctagatccctaatgggggctaggggtggggagaatctagcagaagttgtccaggatactgtggatcaagtatcaatctgaaattaagagaaattagatactaagaggatggacatttacatgtctgtttcctttcctttcattttcattctaacataggaaatgctaacagatggggctggcccaaagtcaagcttctgactccacttgacacagtgccattgggcatgtccctctctgaagggcttgtttgtctatcagagactgtcagaactccatgagggcaggagaagggattttgcaggatgaaagtgcttgggaagtagtggccaccgttctgggggtttcagcccacctaccccatccaccgggctttctaatcacagtcctgcctgagaagcgggccctgctgcccaccccttatcatggatcccttagctactgtccgtcttccattgctgcctggggctgggctgccgtttttgaacacctggcagtgtctttgtcgcgtcctgtcctctcttcttacagaccccaacccaggcctttgccttcttctctcctgtttggaagcctctgtatcttcaaggtgtgggaacagatttggttttctctaaaaagctagaaccttctgctgtgtgcagcaggcatcctccaggctggtgctggctgctctcgaggaagctgcgtcagagtggagctgcccctctactcagataaaatagcttcagctgcaggaagccgccccctcccatgcccaccagcccacagcccttcaccccacacagcccccagagtttgcccgacaccccctgagtgatgacaggtctcaggagggggccgcccccacaaatgggaggcggaagcttattttccccgcttgggctgggggcggctgctgagggggtgaagaagagatagcaatttatgtcgcatgtttagtgacacaatccagatgcaggtgggactttcttgagtggcaggtgtcaccctgggtcccgtgtgggatggtttaatacaggggtttgtgtgtttgtgtgtgtggagggccactgcgcccccagatcctcctctcccccgagggctgcgtctctaaacctgggaaaacatcagcctcaggaggaggcccctttccgggtaactgatgtgtgggagaagccaagaggcccctgcctgtctcctgaatgaggctgtgagggttgccatgtgggcgggaccggttcaaaatagcgcccccgcccctctaaattagaccgtggtctcagcatgatcatcttcagtagataagggacagtggctgatttactccaaatagttccagctggccactcagaccagggccagagttaacttctcaaacaccagccagctgaaaattagggttctcgtgcaggcaagtgcatggttgacacacagccctttggtgacaaagctgggctttgcctgcatagtgcagacaaggctgttggttcagaggctgcagggcacattccaggttggggccttttgtcggtcggaattcaataggacattccctggctgtgggtgtttagggcaggaattacaggcttgcagagaaagtcagaggcaatgagatgctcccagtaccaaactgtgacactgggatcagggtggtcattcccttgggtcagagtgggaccctagagccagagtgagctgtgggtggcctgggtgtgtcctgtggacggcggagactgttgatttggatgttgagctctgagtcagtttcagaaccaaggatctcaggctgagaaggccaggtccccatgggagcggcaggagtctgatggctctgctgccagagcctaccccagcctgccacgccgctgaccttcccatggtaaggaaggggcaggcagcatggttcccaccctcagctgccccagacccacacatccagccccaagagcagcctcacccaggcacagtgcagggcattttagctcctgggaggggagatgcctttgtgagtttcagatgtcagaggagaagctccgagagagtaagtcatgtgcccccaaacactcagctcctaagtggcaggacaggcaagtggccaggttgggccgcccccacagcctgtgccgtccacacactcactacagcactcccagaagaaggagcagaatcgcatgcagcccagagcaggtcctgtggaggggtcctcacccctcaggagtaatagggtgattatgtcacatgtttagtgatacaatcccacctgtgtctggattgtgtcactaaacatgcaacataaattaccatctcttctccatcccctcagcagccgcccccaccccaagctgggaaaataagcttctccctcccatatgtgggggcggccccctcctgagacctgtcatcacttagggggagttgggcaaaacctcctaggaaggtcctggacgcctccaccctgccccacaaggctccgtactcccacctgcctgggcagccctcacacccatgctccctcctttaggcaggcccagaaaggtgccccttcctgagggtgttgggggatggcggcagagagacagctggtattaggagcttccccatcctaatgtgcaggaccaagttgcccgctctgccagccaggggctccagccatgctggcacaggcatctcagaggtgtgagatgaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccaggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgttttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggttctgtgtgtatcaacttaatttgcatatgaatgagtgttgtgttgtgatttgcagtgttttgacaccgtgattggctttgtttgggtctctcttctttctgtgaaattaactgctgtgcgttttcactgttcttagagaagaccctgagctcctggggttttcttgtctcacttctaccctgacctgctgggagcccaccccaccccagtccagccatgagggtatttccagcctattccaatgactgaaacccttcttggaagaaaacgtctaatgtcggggacgtagggacgcttccagacttgccctggccggaaccctgcagcctggggccccagcccgcctgcagctcagctttccccaacaccctcaggacccagccccagccccggcagaccttccctgggagctgcttaggtggtctccacagcgccctctaggggccaagcagggttccagattctccagccttctgccagctttaaaacccttcactcaagcagcattactgtacatgcaatgaaaaatactatatatgacagtcaaaacctgtgtacatatttccatgtacatatttatacatacacacaccttcctattataaatatataaagcatgacatctctttggcattccaagtttgtgtttttttaaatccttggaaatacggctttggaaacctttttcttcctttccctcttttctatgttgtaataaacattcatgtgaccttt

SEQ ID NO: 1109 - DNA, 7705 bp, Homo sapiens
gagctcggcgcggagcccggagcccgcagccgacagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactggggacattcgtctcggccttcactgtgctgtgcggggcccgcaccgacctcccggacaggcatgtgtgctgcgtcttctggctgaacattgcagcagccctcatccaaatcctcactgccatcgtcatggtgggctggatcatgagcatcttctggggcatggacatggtcatccttgccacttccacaggctacaaggagcagggcatcccacagcagctgtgagcccacgggagccgctggggagatccaggggggccctgtgagggctgcaccaggcagctttgggcacaaggacctttacatgttcttttctgccattttctggactgggggtggaaagggggtatttttaaaaatattatttattttgaaaacgcatctgcttttctcagcaggttgtgagggctgccagcccctcctgctctggaaagcactgtgggcgcaggcaccagagcatcagagagtggggtggagatgagaacgcccacagagaggctgggatgctccggcaggctccaactggccttgctgtacccactgcccaccgcaaaggcacgccacgtctgctgggccgggccacaccgggccctgtctgggtgagcaggggctcaccaaggggacaggactgtggtagacccgtcctgtgggaccccacctgcctcaaaatctggtgccccgagtgtttactgtgtggtctcctgggggcagcaccagggtgtgggtgaggatggccaggctccaccctagcgtggaaaggcccactgtgcccacagctggcctgaggcctcggggagaagaccagtcccacaggcgtctcctgggcctgcctccctgaccgcaccccccgcctcctcgcagctgaaatctgagggctgggtgtgtcgtgacctgtgttttcctgggaaggagaggagtagctccttccctggggtgaaactgccagatgtttatacacaaagttattagactgaagcaggagtgggcagactagcaggctttcacccaatacttaacagcatttctggcccacattcctttttctgaagtcattggggccagatgtgtctccgaattgagaaattttagatttgagaaagacaatgcgatccatttatcgtacactttctaacttcccggcagagtgtggaacatctcgcctaccatcaggcacgtgaatatttctgcagagaaacatgtgactagtcccattaactgggagctatacaaactgtaaatagcctcacctcagttcagtctaattttgccactaagtaacttagggaaaaacttaccatttgagagcttttagggtttcagaattgcaagaacaattgtatggggttgtggaccttgatctgaaaatcctgcttgcaaacagatgtgttagagggtgaaattgtcggcattacacaaggactccttcagttgccaaaagaccatgggcctctttaaggagcccctctgtaagtgattgggacagggctagatccctaatgggggctaggggtggggagaatctagcagaagttgtccaggatactgtggatcaagtatcaatctgaaattaagagaaattagatactaagaggatggacatttacatgtctgtttcctttcctttcattttcattctaacataggaaatgctaacagatggggctggcccaaagtcaagcttctgactccacttgacacagtgccattgggcatgtccctctctgaagggcttgtttgtctatcagagactgtcagaactccatgagggcaggagaagggattttgcaggatgaaagtgcttgggaagtagtggccaccgttctgggggtttcagcccacctaccccatccaccgggctttctaatcacagtcctgcctgagaagcgggccctgctgcccaccccttatcatggatcccttagctactgtccgtcttccattgctgcctggggctgggctgccgtttttgaacacctggcagtgtctttgtcgcgtcctgtcctctcttcttacagaccccaacccaggcctttgccttcttctctcctgtttggaagcctctgtatcttcaaggtgtgggaacagatttggttttctctaaaaagctagaaccttctgctgtgtgcagcaggcatcctccaggctggtgctggctgctctcgaggaagctgcgtcagagtggagctgcccctctactcagataaaatagcttcagctgcaggaagccgccccctcccatgcccaccagcccacagcccttcaccccacacagcccccagagtttgcccgacaccccctgagtgatgacaggtctcaggagggggccgcccccacaaatgggaggcggaagcttattttccccgcttgggctgggggcggctgctgagggggtgaagaagagatagcaatttatgtcgcatgtttagtgacacaatccagatgcaggtgggactttcttgagtggcaggtgtcaccctgggtcccgtgtgggatggtttaatacaggggtttgtgtgtttgtgtgtgtggagggccactgcgcccccagatcctcctctcccccgagggctgcgtctctaaacctgggaaaacatcagcctcaggaggaggcccctttccgggtaactgatgtgtgggagaagccaagaggcccctgcctgtctcctgaatgaggctgtgagggttgccatgtgggcgggaccggttcaaaatagcgcccccgcccctctaaattagaccgtggtctcagcatgatcatcttcagtagataagggacagtggctgatttactccaaatagttccagctggccactcagaccagggccagagttaacttctcaaacaccagccagctgaaaattagggttctcgtgcaggcaagtgcatggttgacacacagccctttggtgacaaagctgggctttgcctgcatagtgcagacaaggctgttggttcagaggctgcagggcacattccaggttggggccttttgtcggtcggaattcaataggacattccctggctgtgggtgtttagggcaggaattacaggcttgcagagaaagtcagaggcaatgagatgctcccagtaccaaactgtgacactgggatcagggtggtcattcccttgggtcagagtgggaccctagagccagagtgagctgtgggtggcctgggtgtgtcctgtggacggcggagactgttgatttggatgttgagctctgagtcagtttcagaaccaaggatctcaggctgagaaggccaggtccccatgggagcggcaggagtctgatggctctgctgccagagcctaccccagcctgccacgccgctgaccttcccatggtaaggaaggggcaggcagcatggttcccaccctcagctgccccagacccacacatccagccccaagagcagcctcacccaggcacagtgcagggcattttagctcctgggaggggagatgcctttgtgagtttcagatgtcagaggagaagctccgagagagtaagtcatgtgcccccaaacactcagctcctaagtggcaggacaggcaagtggccaggttgggccgcccccacagcctgtgccgtccacacactcactacagcactcccagaagaaggagcagaatcgcatgcagcccagagcaggtcctgtggaggggtcctcacccctcaggagtaatagggtgattatgtcacatgtttagtgatacaatcccacctgtgtctggattgtgtcactaaacatgcaacataaattaccatctcttctccatcccctcagcagccgcccccaccccaagctgggaaaataagcttctccctcccatatgtgggggcggccccctcctgagacctgtcatcacttagggggagttgggcaaaacctcctaggaaggtcctggacgcctccaccctgccccacaaggctccgtactcccacctgcctgggcagccctcacacccatgctccctcctttaggcaggcccagaaaggtgccccttcctgagggtgttgggggatggcggcagagagacagctggtattaggagcttccccatcctaatgtgcaggaccaagttgcccgctctgccagccaggggctccagccatgctggcacaggcatctcagaggtgtgagatgaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccaggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgttttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggttctgtgtgtatcaacttaatttgcatatgaatgagtgttgtgttgtgatttgcagtgttttgacaccgtgattggctttgtttgggtctctcttctttctgtgaaattaactgctgtgcgttttcactgttcttagagaagaccctgagctcctggggttttcttgtctcacttctaccctgacctgctgggagcccaccccaccccagtccagccatgagggtatttccagcctattccaatgactgaaacccttcttggaagaaaacgtctaatgtcggggacgtagggacgcttccagacttgccctggccggaaccctgcagcctggggccccagcccgcctgcagctcagctttccccaacaccctcaggacccagccccagccccggcagaccttccctgggagctgcttaggtggtctccacagcgccctctaggggccaagcagggttccagattctccagccttctgccagctttaaaacccttcactcaagcagcattactgtacatgcaatgaaaaatactatatatgacagtcaaaacctgtgtacatatttccatgtacatatttatacatacacacaccttcctattataaatatataaagcatgacatctctttggcattccaagtttgtgtttttttaaatccttggaaatacggctttggaaacctttttcttcctttccctcttttctatgttgtaataaacattcatgtgaccttt

SEQ ID NO: 1110 - DNA, 2120 bp, Homo sapiens
cacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgtgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtgggtgagagcagggcactgtccagctgtccactggggaagtcaagatgtcctaaggcccaggtcagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacaagcaattacccagtttccttatctataaaatggggacatcagcaatgttcttcacaccctgcaagggctgggaatctgcgcatgtgaacttggagctgcatttatgagcactgtagacaaatgtttgtatctgtcac

SEQ ID NO: 1111 - DNA, 1127 bp, Homo sapiens
cacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtggggg

SEQ ID NO: 1112 - DNA, 613 bp, Homo sapiens
tgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggaagaaaagatcccagcagtcggagctctggtctgggctctgtagacttcaaattgctctcagggcaccggattcctacaggcagccccagaggagtgtggtgacgctgaggggcggtgggacgcatggcaggccctcaccaccaggcttctgtttcccaacaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagac

SEQ ID NO: 1113 - DNA, 4730 bp, Homo sapiens
ctcgggcttcttgtggagaggcaggagagtgaaggcctgccgcgggtgaggcctccagtccacggacggccacaggccactgcggctggaatcacaggagccatgagcacagagggccccagcctcgccagctccccagccatcagccccctcgcctttctctcagctcccgtcactcccgggacccttgcagaggcaactgaccccctccccatgctcatcgccctggcctgcatcttcctcctgctggccacctgtctgctgttcatgacgctctgcaagccggccgcgctggacccgagccgccgcagggctcacgagtgcatgccccaccaccctgggagccccagtgagccccagctccggctctggaagcgcctgggctccttgcgcctctccctgcacagcttccgccatggccggcccaccgtccctcgacagcccctgccgggccccgaggacaaccgcagccactgtgactacatggaatctaccaagatgtaatggggtgtccacaaacatgcccccacatccccctaggtctacctgtagatcctcctgcttcagagaccggtgctgcaggctgcaggaagacagtggcccaagcagtctgggacacacactcaccccccgaagctccttgcatgcccaggccagcgccctttcccaaagatgatcctcagaagagcaccttcctctctgcagaccccctcgctgctgcttgatgaaagacttctggtcaagagatgtgcactcgtggtcatctgggcctttggcctgaggctccacagggtacaacctggggctcgtaaccacctcctagaagcagcaccctcgctcgccacagaagccttgccctccaggtgccaaagcccagcatggagaagttgccaaatggcaaaggttccctttagtcaagtgaaatgctcagcctacaccggggccaagacactgtcctggcatctgtgctggcccagtgctggggcaaaacctcggggctctcttccttgggtttcccgggtgctgccagcatctgcctggtgccctgtgggagcagctgcctccctcctggtggaacagatgcctgggtgccagctgggaggaggagcaaacagggctctccaagcatggtcttggcagccgtcttggtggcccctcttcagggcacccacgttgggatcaatcaggaagggattgaagatgatcgaggaggctcccttcagaggccagggcgggtgctgtgacagagtggcaagaggcagggcatttccagcagctggaggtgatgccacctggactcggaggaggacagctcacagcagctccacacctcacccagggaaagcggcagcctccccgagggtgggatggtctggacctctccaggacagctgtggggtcccaagtcctgcccacactagggatgctatctgtggttttggtgagtgctttgctgatgacccgtcaaagcagtcccaccccaggatgggcttctcagaatcccaaacccttgacctctcctcacaacgcgagggttaaacactttggtcaggtcccaaatttgaagggtgggcagagggaggacctgggctgcccagctcctgtcccagtcagctggccaggatcccaccacaaagctgccccacccccatcctgctgtgacccacagtgcagccagccacgtctccccaaggagtgagctctggcttgccactccccagctccaaaaccttcactggctccctaatgccaaatggatatagccaaagctcctcagcgcagtgtgcagtgccctctgggagctggctccaattaatctttctagcctcatcttgatccaaaactccaggaaaactgaaagacctgtcacccactaactgtggcttatgcttcacacacacccactctgtgaagccctcctgcctggagccgcccctactgtctcctacctctcttggggaggaaaaggaacattctcttggcagcatgggtcctttttgtctatgtcttctctttcctaccagcttgggagcttgcagagagccagacattgtccagcccctcactttgactccccagttctgtgcacagaagtatgaggcttctgtgtacagagtgaagcgtggcccagcctgggtgtgtccccaccctctgaggcaggagtcttggtggaagctggcataacacagagcctcatcttccctcagatgactctagaaagatttctctccaagcaggctctattggagaagcccactgtcccttccttccaagtcaatctgatctcaaaaagtgagtccggcttcacaagaaacttaccaagaggaccttggagaagtcatcctgagacgctgcatttctccctgagaaatgggagaactcagggctgccctatattaactcgctggctctaggatttcagtaagagtagtattgtgtaaatagaaaccaagtctttgggtttagaaagtggggcaggcctcctccctaagggttttgttccttcctcccttcctgctcagtaacctcttcctggtttgcttcccctggggcctccctgcaaatcctaggctggattcagcctgtagccatccacctcaccagcaggccctgctggccactaggcactgtcttcctggaggttggggtgggggttgaggctgccctgaggcctgaagaaggaaaagtccaggagggggagggctctcaattgggtttcaggcaccaggccaggggggtatgctccaagtcctcacaagctgaggccctgatcgagagaaccctctacttcctccttctggagctagccaccacactctcgcaaatcctcagggctttctgggctctctgtgtttctgggagtcagctccctgctccccagccctttcctgcccgcctcctggtcccgatgcagggaggggagcattgccagcctcccacgcttctgtccctcccaagcccgggagcctgccccagtgggcaggcccagattccctgtttggctcagcctccgagtcggaaaccccatagttggtaaagagactcattcactccgggcctccctccccacccagcaactgaggcctctgggcagaggtgtgggtgcacacccaaattgttttcagggtcctcccttctctccctctgagccttggagctgttgcgcctgctccctgggcaaaggagccctttcttcttgtgcctgtttacttcccaagaggggagcctcggccaagggctctgtgaaagcagctctgttctgggccttgctgggccctggctctcttctcaactcctttccgggaaattgtgacgtctctttctccccgctactctgaaaggcccttctgggtggggcgggagatatgcagggggaggccaagtcttcctcctgtttgtggggagccagagccctatcctcagctctgcaacctgggggcccacactccctgggatgggagagggcctgggtccccctttccccacagcaccttccagagcagcggacccaccctgggcccccacctgcttccgcctctggtgccactgagcatgtgccctcagggccgtgtgtggctccgcctcccccagcccaccacctgccccagaggccacgggccacctgcctgcaagatgctgtggccttcagggatgtcctcagggacgctggcctcatagctgctctgcagaaagatgggccggttgtcattcacatccaggacagtgacgaacacggtggctgtgcccgtgtgtcgcttccctacagggccgttgtctgtgggagttgaaggaagacaggtgttagcagctgcctgagagaggggcacacttcctgtgactttgcacactcccgggcaccggccagagaggtgccctgttccgccccatctgccctagcctttgcaaggggtgacttcctttttagcttaggaataacactaacagtatcaaatacttagataacaccatgtgccagccattcttctaacccattcagtcctcacagcaaccccatgaagcagacactttactgtcatccccattttacagaggaggtaactgaggcactcaagtggattgaatgatggctcccaaaaaaaacagacccatgttaaacccctgggaacctgtgaagattaatttatttgggaaaagggcctttgaaaatgtaattacgttaaggatcttgagaagtgatcatcctgggtgagctgggtggcccataaacccaatggcaagtgtccttacaagagaaaggcagagggacatttgagacagagaggaggaggccacatgcagatggaggcagaggctggagttatgctgccacaagccaccgaatgcctagcgactccagaaactgggacggtcaaggactgattctctctagagcctttggaggaagcgtgaccctgccgacaccttaatttctaacttctggccttgagaaccaggagagaatacacttctgctgttttaagtttgtggtagtttgtcgtggcaaatttaggatgcagatacaggtactaagagcaaaaagccaactgctgtcagggactggcgggtatagcacctgggtcaaacacctggatgggccccgctggaagggcagctgtcctccactccagtccacagcggacaggcagaatgtgggcccagagacaccagatcttctgatttctcatgagaaattgaacatctgagcttttaaataaaatctcctgatcttt

SEQ ID NO: 1114 - DNA, 4837 bp, Homo sapiens
ttctagacaaagccaggtccagctggggagtgacggggaggccactctgctggccaggctgaccgagggctgcagggcacagcagagcctggcagggctggggtcacaggcactgcccagggctccttgggcctcccttccacagctgagaagacctctccacggagctccggacggctggggtctggctctgaggagccatgagcacagagggccccagcctcgccagctccccagccatcagccccctcgcctttctctcagctcccgtcactcccgggacccttgcagaggcaactgaccccctccccatgctcatcgccctggcctgcatcttcctcctgctggccacctgtctgctgttcatgacgctctgcaagccggccgcgctggacccgagccgccgcagggctcacgagtgcatgccccaccaccctgggagccccagtgagccccagctccggctctggaagcgcctgggctccttgcgcctctccctgcacagcttccgccatggccggcccaccgtccctcgacagcccctgccgggccccgaggacaaccgcagccactgtgactacatggaatctaccaagatgtaatggggtgtccacaaacatgcccccacatccccctaggtctacctgtagatcctcctgcttcagagaccggtgctgcaggctgcaggaagacagtggcccaagcagtctgggacacacactcaccccccgaagctccttgcatgcccaggccagcgccctttcccaaagatgatcctcagaagagcaccttcctctctgcagaccccctcgctgctgcttgatgaaagacttctggtcaagagatgtgcactcgtggtcatctgggcctttggcctgaggctccacagggtacaacctggggctcgtaaccacctcctagaagcagcaccctcgctcgccacagaagccttgccctccaggtgccaaagcccagcatggagaagttgccaaatggcaaaggttccctttagtcaagtgaaatgctcagcctacaccggggccaagacactgtcctggcatctgtgctggcccagtgctggggcaaaacctcggggctctcttccttgggtttcccgggtgctgccagcatctgcctggtgccctgtgggagcagctgcctccctcctggtggaacagatgcctgggtgccagctgggaggaggagcaaacagggctctccaagcatggtcttggcagccgtcttggtggcccctcttcagggcacccacgttgggatcaatcaggaagggattgaagatgatcgaggaggctcccttcagaggccagggcgggtgctgtgacagagtggcaagaggcagggcatttccagcagctggaggtgatgccacctggactcggaggaggacagctcacagcagctccacacctcacccagggaaagcggcagcctccccgagggtgggatggtctggacctctccaggacagctgtggggtcccaagtcctgcccacactagggatgctatctgtggttttggtgagtgctttgctgatgacccgtcaaagcagtcccaccccaggatgggcttctcagaatcccaaacccttgacctctcctcacaacgcgagggttaaacactttggtcaggtcccaaatttgaagggtgggcagagggaggacctgggctgcccagctcctgtcccagtcagctggccaggatcccaccacaaagctgccccacccccatcctgctgtgacccacagtgcagccagccacgtctccccaaggagtgagctctggcttgccactccccagctccaaaaccttcactggctccctaatgccaaatggatatagccaaagctcctcagcgcagtgtgcagtgccctctgggagctggctccaattaatctttctagcctcatcttgatccaaaactccaggaaaactgaaagacctgtcacccactaactgtggcttatgcttcacacacacccactctgtgaagccctcctgcctggagccgcccctactgtctcctacctctcttggggaggaaaaggaacattctcttggcagcatgggtcctttttgtctatgtcttctctttcctaccagcttgggagcttgcagagagccagacattgtccagcccctcactttgactccccagttctgtgcacagaagtatgaggcttctgtgtacagagtgaagcgtggcccagcctgggtgtgtccccaccctctgaggcaggagtcttggtggaagctggcataacacagagcctcatcttccctcagatgactctagaaagatttctctccaagcaggctctattggagaagcccactgtcccttccttccaagtcaatctgatctcaaaaagtgagtccggcttcacaagaaacttaccaagaggaccttggagaagtcatcctgagacgctgcatttctccctgagaaatgggagaactcagggctgccctatattaactcgctggctctaggatttcagtaagagtagtattgtgtaaatagaaaccaagtctttgggtttagaaagtggggcaggcctcctccctaagggttttgttccttcctcccttcctgctcagtaacctcttcctggtttgcttcccctggggcctccctgcaaatcctaggctggattcagcctgtagccatccacctcaccagcaggccctgctggccactaggcactgtcttcctggaggttggggtgggggttgaggctgccctgaggcctgaagaaggaaaagtccaggagggggagggctctcaattgggtttcaggcaccaggccaggggggtatgctccaagtcctcacaagctgaggccctgatcgagagaaccctctacttcctccttctggagctagccaccacactctcgcaaatcctcagggctttctgggctctctgtgtttctgggagtcagctccctgctccccagccctttcctgcccgcctcctggtcccgatgcagggaggggagcattgccagcctcccacgcttctgtccctcccaagcccgggagcctgccccagtgggcaggcccagattccctgtttggctcagcctccgagtcggaaaccccatagttggtaaagagactcattcactccgggcctccctccccacccagcaactgaggcctctgggcagaggtgtgggtgcacacccaaattgttttcagggtcctcccttctctccctctgagccttggagctgttgcgcctgctccctgggcaaaggagccctttcttcttgtgcctgtttacttcccaagaggggagcctcggccaagggctctgtgaaagcagctctgttctgggccttgctgggccctggctctcttctcaactcctttccgggaaattgtgacgtctctttctccccgctactctgaaaggcccttctgggtggggcgggagatatgcagggggaggccaagtcttcctcctgtttgtggggagccagagccctatcctcagctctgcaacctgggggcccacactccctgggatgggagagggcctgggtccccctttccccacagcaccttccagagcagcggacccaccctgggcccccacctgcttccgcctctggtgccactgagcatgtgccctcagggccgtgtgtggctccgcctcccccagcccaccacctgccccagaggccacgggccacctgcctgcaagatgctgtggccttcagggatgtcctcagggacgctggcctcatagctgctctgcagaaagatgggccggttgtcattcacatccaggacagtgacgaacacggtggctgtgcccgtgtgtcgcttccctacagggccgttgtctgtgggagttgaaggaagacaggtgttagcagctgcctgagagaggggcacacttcctgtgactttgcacactcccgggcaccggccagagaggtgccctgttccgccccatctgccctagcctttgcaaggggtgacttcctttttagcttaggaataacactaacagtatcaaatacttagataacaccatgtgccagccattcttctaacccattcagtcctcacagcaaccccatgaagcagacactttactgtcatccccattttacagaggaggtaactgaggcactcaagtggattgaatgatggctcccaaaaaaaacagacccatgttaaacccctgggaacctgtgaagattaatttatttgggaaaagggcctttgaaaatgtaattacgttaaggatcttgagaagtgatcatcctgggtgagctgggtggcccataaacccaatggcaagtgtccttacaagagaaaggcagagggacatttgagacagagaggaggaggccacatgcagatggaggcagaggctggagttatgctgccacaagccaccgaatgcctagcgactccagaaactgggacggtcaaggactgattctctctagagcctttggaggaagcgtgaccctgccgacaccttaatttctaacttctggccttgagaaccaggagagaatacacttctgctgttttaagtttgtggtagtttgtcgtggcaaatttaggatgcagatacaggtactaagagcaaaaagccaactgctgtcagggactggcgggtatagcacctgggtcaaacacctggatgggccccgctggaagggcagctgtcctccactccagtccacagcggacaggcagaatgtgggcccagagacaccagatcttctgatttctcatgagaaattgaacatctgagcttttaaataaaatctcctgatctttaaactttca

SEQ ID NO: 1115 - DNA, 4739 bp, Homo sapiens
ctcgggcttcttgtggagaggcaggagagtgaaggcctgccgcgggtgaggcctccagtccacggacggccacaggccactgcggctggaatcacaggagccatgagcacagagggccccagcctcgccagctccccagccatcagccccctcgcctttctctcagctcccgtcactcccgggacccttgcagaggcaactgaccccctccccatgctcatcgccctggcctgcatcttcctcctgctggccacctgtctgctgttcatgacgctctgcaagccggccgcgctggacccgagccgccgcagggctcacgagtgcatgccccaccaccctgggagccccagtgagccccagctccggctctggaagcgcctgggctccttgcgcctctccctgcacagcttccgccatggccggcccaccgtccctcgacagcccctgccgggccccgaggacaaccgcagccactgtgactacatggaatctaccaagatgtaatggggtgtccacaaacatgcccccacatccccctaggtctacctgtagatcctcctgcttcagagaccggtgctgcaggctgcaggaagacagtggcccaagcagtctgggacacacactcaccccccgaagctccttgcatgcccaggccagcgccctttcccaaagatgatcctcagaagagcaccttcctctctgcagaccccctcgctgctgcttgatgaaagacttctggtcaagagatgtgcactcgtggtcatctgggcctttggcctgaggctccacagggtacaacctggggctcgtaaccacctcctagaagcagcaccctcgctcgccacagaagccttgccctccaggtgccaaagcccagcatggagaagttgccaaatggcaaaggttccctttagtcaagtgaaatgctcagcctacaccggggccaagacactgtcctggcatctgtgctggcccagtgctggggcaaaacctcggggctctcttccttgggtttcccgggtgctgccagcatctgcctggtgccctgtgggagcagctgcctccctcctggtggaacagatgcctgggtgccagctgggaggaggagcaaacagggctctccaagcatggtcttggcagccgtcttggtggcccctcttcagggcacccacgttgggatcaatcaggaagggattgaagatgatcgaggaggctcccttcagaggccagggcgggtgctgtgacagagtggcaagaggcagggcatttccagcagctggaggtgatgccacctggactcggaggaggacagctcacagcagctccacacctcacccagggaaagcggcagcctccccgagggtgggatggtctggacctctccaggacagctgtggggtcccaagtcctgcccacactagggatgctatctgtggttttggtgagtgctttgctgatgacccgtcaaagcagtcccaccccaggatgggcttctcagaatcccaaacccttgacctctcctcacaacgcgagggttaaacactttggtcaggtcccaaatttgaagggtgggcagagggaggacctgggctgcccagctcctgtcccagtcagctggccaggatcccaccacaaagctgccccacccccatcctgctgtgacccacagtgcagccagccacgtctccccaaggagtgagctctggcttgccactccccagctccaaaaccttcactggctccctaatgccaaatggatatagccaaagctcctcagcgcagtgtgcagtgccctctgggagctggctccaattaatctttctagcctcatcttgatccaaaactccaggaaaactgaaagacctgtcacccactaactgtggcttatgcttcacacacacccactctgtgaagccctcctgcctggagccgcccctactgtctcctacctctcttggggaggaaaaggaacattctcttggcagcatgggtcctttttgtctatgtcttctctttcctaccagcttgggagcttgcagagagccagacattgtccagcccctcactttgactccccagttctgtgcacagaagtatgaggcttctgtgtacagagtgaagcgtggcccagcctgggtgtgtccccaccctctgaggcaggagtcttggtggaagctggcataacacagagcctcatcttccctcagatgactctagaaagatttctctccaagcaggctctattggagaagcccactgtcccttccttccaagtcaatctgatctcaaaaagtgagtccggcttcacaagaaacttaccaagaggaccttggagaagtcatcctgagacgctgcatttctccctgagaaatgggagaactcagggctgccctatattaactcgctggctctaggatttcagtaagagtagtattgtgtaaatagaaaccaagtctttgggtttagaaagtggggcaggcctcctccctaagggttttgttccttcctcccttcctgctcagtaacctcttcctggtttgcttcccctggggcctccctgcaaatcctaggctggattcagcctgtagccatccacctcaccagcaggccctgctggccactaggcactgtcttcctggaggttggggtgggggttgaggctgccctgaggcctgaagaaggaaaagtccaggagggggagggctctcaattgggtttcaggcaccaggccaggggggtatgctccaagtcctcacaagctgaggccctgatcgagagaaccctctacttcctccttctggagctagccaccacactctcgcaaatcctcagggctttctgggctctctgtgtttctgggagtcagctccctgctccccagccctttcctgcccgcctcctggtcccgatgcagggaggggagcattgccagcctcccacgcttctgtccctcccaagcccgggagcctgccccagtgggcaggcccagattccctgtttggctcagcctccgagtcggaaaccccatagttggtaaagagactcattcactccgggcctccctccccacccagcaactgaggcctctgggcagaggtgtgggtgcacacccaaattgttttcagggtcctcccttctctccctctgagccttggagctgttgcgcctgctccctgggcaaaggagccctttcttcttgtgcctgtttacttcccaagaggggagcctcggccaagggctctgtgaaagcagctctgttctgggccttgctgggccctggctctcttctcaactcctttccgggaaattgtgacgtctctttctccccgctactctgaaaggcccttctgggtggggcgggagatatgcagggggaggccaagtcttcctcctgtttgtggggagccagagccctatcctcagctctgcaacctgggggcccacactccctgggatgggagagggcctgggtccccctttccccacagcaccttccagagcagcggacccaccctgggcccccacctgcttccgcctctggtgccactgagcatgtgccctcagggccgtgtgtggctccgcctcccccagcccaccacctgccccagaggccacgggccacctgcctgcaagatgctgtggccttcagggatgtcctcagggacgctggcctcatagctgctctgcagaaagatgggccggttgtcattcacatccaggacagtgacgaacacggtggctgtgcccgtgtgtcgcttccctacagggccgttgtctgtgggagttgaaggaagacaggtgttagcagctgcctgagagaggggcacacttcctgtgactttgcacactcccgggcaccggccagagaggtgccctgttccgccccatctgccctagcctttgcaaggggtgacttcctttttagcttaggaataacactaacagtatcaaatacttagataacaccatgtgccagccattcttctaacccattcagtcctcacagcaaccccatgaagcagacactttactgtcatccccattttacagaggaggtaactgaggcactcaagtggattgaatgatggctcccaaaaaaaacagacccatgttaaacccctgggaacctgtgaagattaatttatttgggaaaagggcctttgaaaatgtaattacgttaaggatcttgagaagtgatcatcctgggtgagctgggtggcccataaacccaatggcaagtgtccttacaagagaaaggcagagggacatttgagacagagaggaggaggccacatgcagatggaggcagaggctggagttatgctgccacaagccaccgaatgcctagcgactccagaaactgggacggtcaaggactgattctctctagagcctttggaggaagcgtgaccctgccgacaccttaatttctaacttctggccttgagaaccaggagagaatacacttctgctgttttaagtttgtggtagtttgtcgtggcaaatttaggatgcagatacaggtactaagagcaaaaagccaactgctgtcagggactggcgggtatagcacctgggtcaaacacctggatgggccccgctggaagggcagctgtcctccactccagtccacagcggacaggcagaatgtgggcccagagacaccagatcttctgatttctcatgagaaattgaacatctgagcttttaaataaaatctcctgatctttaaactttca

SEQ ID NO: 1116 - DNA, 1714 bp, Homo sapiens
ctcccggcctcgcctcgcagacgcgacgggccggggaggaagcgctcggagcagtgcaggtttcgttatcctgtgttaggtcactccggagaggggaaagcggcccacagcgtcgcgcgacccggaaacgacacaacgaggcccaatcttttagactcgagtttaggccccggggtggagtctccggaccgggtccccccacccccgctacaggggcagtgcgcaggcgcgagggacgcacaaccccagcccctgtcccagtgagcccgtcgccatggaatccctgcagactccccagcaccgcgaaaatcaagataaaagggagaaggagtatggggtaaaacacatgcctatgggcaataatgcagggaatcttgagcccgaaaagagaaaggcagtaagagttgccttgagttcagcaacagctgcacagaatatcccgtccagtgtccactgtggctgctccaagcaatggagactcaggctaccatcggagtcgctgcaaagtcggggacaagtgatgaagcggccgaataacattttaaagctcaggaatctggatctgttgatctacccttggccagaacttagaagacggcaggttgcttctgacctaatgagcctcctccttctccccgctttttccggccttacttgggcccccttccttttcctctttacgtatctgcctccttttctcaatctcctcactgttggttttgtatcctattttctggtatagtttctgtgatttctttcttttatttattattattattgttgttgagacagagttttgcccttgttgcccaggctggagtgcaatggcgcgaacctggctcactccagccagcgcctcacaggttcaggtgattctcctgcctcagcctccggagtagctggggttacaggcacgggccaccagcccagctaatttttgtatttttagtacagacggtgtttcaccatgttagtcaggctggtctcgaactcctgacctcaggtgatccgcccacctcggccttccaaagtgctgggattacaggcatgagctactgtgcccagcctctatgatttcaattttcatgtttaagtacctatgtagaacctaactgtccataagtaaacacaacaaaaaaaagatttggcttttggtcaaagatcattggaggttacacagggtaaagtgcagtatgatttttatcacaattagaaagattaaaaagagatgacagtgagtttgtgagaacaggtttgtgtttcataaaatgaattgtgtgagttagctatgatgaactgcaagcagcttgcatttccaaagacaaatagagacacaggaatctaattaaaatgctaaagtaatgggaaggagacatccatacgtttttgtccccctaaggttccagatttatagtttgagcatcatctcggcttacattttctctgtggaaaacatcagccattacattacttggctctgggttgaaatcctaacttcatcaactgaagatcttatgacctaggcaagtttattaacctcctctatgacgtgataaaaatagtatctcttgtgcggattagaagacatgttcctctatgctaagatgattattatgtgcggaacacatagttaagtgcttgataaattgaactatggcaaatccagtctcaaccgtggcaaaactaagttaataaaaatgaaacataaccttta

SEQ ID NO: 1117 - DNA, 1761 bp, Homo sapiens
agaatgcccaagaggaaggtcagctctgctgaaggggccgccacaggaaaagcctaacaggaggtcagcgctgttgtcagtgggagagatctctgagctttgtccggaaatcactgattttttgtgccgggacaagaagtgcattgcatcccaccttctttgtgactataagccagactgctctgataggtctgatgaagctcactgtgcacattatacaagcacaacaggaagctgcaattttgaaacaagttcaggaaactggaccacagcctgcagtcttactcaagactctgaggatgacttggactgggccattggcagcagaattcctgccaaagcattaattccagactctgatcacacgccaggtagtggtcagcacttcctgtacgtcaactcatctggctccaaggaaggatccgttgccagaattactacttccaaatccttcccagcaagccttggaatgtgtactgttcggttctggttctacatgattgatcccaggagtatgggaatattaaaggtgtataccattgaagaatcggggctaaacatcctggtgtggtcagtgattggaaataaaagaacgggatggacatatggctctgtgcctctctccagtaacagtccgtttaaggtggcatttgaagctgatttggatggaaatgaggacatctttattgctcttgatgacatctcttttaccccagagtgtgtgactggaggtcctgtcccagtgcagccatcaccctgtgaagctgatcagttttcttgtatctacacactccaatgtgtccctctctcagggaaatgtgatggacatgaagactgcatagatggatctgatgaaatggattgtcctctcagccccacccctccactctgtagtaacatggagttcccgtgctctacagacgagtgtataccttccctcctgctatgcgatggagtgcccgactgccactttaatgaagatgagctcatctgctccaacaaaagctgttctaatggagctctggtgtgtgcctcctccaacagctgtatcccagcccaccagcgctgtgatggttttgccgactgcatggatttccagcttgatgagtccagctgctccgaatgtccattaaattactgcagaaatggtgggacttgtgtagtggagaaaaatggtcctatgtgtcgatgtagacaaggctggaaaggaaatcgatgccatatcaagtttaatcctcctgctacagacttcacatacgctcagaataatacatggactctcctgggtattggattagcattcctgatgactcacatcacagttgcagtcttgtgttttcttgcaaacagaaaggtaccaataaggaaaaccgagggaagtggtaactgtgcctttgtcaatccagtttacgggaactggagcaacccagagaaaacagagagttctgtctattccttctcaaacccattatatggcacaacatcaggaagcctggagaccctgtcacatcatctcaaatagcagcatcgagaccaagtctgatccaacatgtgtagtttctagaaaattgaagtctccacaatctgatagaaactcatcttctacaatggtaaaaagagaaaggattgtaaatgccagtgtaattataacatttatgaatgaattttcttgcagaatatagagaatgtttatatggaatcagaatcagtaccttatcttcactgaacatctgaatattttaataaaatttctatttaatc

SEQ ID NO: 1118 - DNA, 4461 bp, Homo sapiens
cctcgggatcatagtctcaacgcatctcaagggcattttatgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggagccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaataccactgatggctggtacctgtatgctgacagttctaatgggaaatttggtgacacggctgacattctcactcctatcatttcactcacgggaccaaaatgtaccttggtgttctggacacatatgaatggggccaccgttggttctctccaggtgctcatcaagaaagataacgttacttctaaattgtgggctcaaactggacagcaaggtgcacagtggaagagagcagaagtgtttttaggcattcgttcacatacacagattgtcttcagagccaaacgtggtatcagttacataggagatgtagcagtggatgatatttccttccaagattgctcccctttgcttagcccagagagaaagtgtactgatcatgaattcatgtgtgctaataagcactgcattgccaaagacaagctgtgtgattttgtgaatgattgtgctgataattcagatgagactactttcatttgccgtacctccagtgggcgctgtgatttcgaatttgatctttgttcctggaagcaggagaaagatgaggactttgactggaacctgaaagctagcagcatccctgcagcaggcacagagccagcagcagatcacactttgggaaattcatctggtcattacatctttataaagagtttgtttcctcagcagcccatgagagctgccagaatttcaagtccagttataagtaagagaagcaaaaactgcaagattatttttcattatcacatgtatggaaatggcattggggcactcaccttaatgcaggtgtcagtcacaaaccaaacgaaggttctacttaacctcactgtagaacaaggcaatttctggcggagagaagaactgtcactgtttggtgatgaagacttccaactcaaatttgaaggtagagttgggaaaggtcagcgtggagacattgcacttgatgacattgtgcttacagaaaattgtctatcactccatgattccgtgcaagaagaactggcagtgcctcttccaacaggtttctgcccacttggctatagggaatgtcataatggaaaatgctataggctggaacaaagctgtaacttcgtagataactgtggagataatactgatgaaaatgagtgtggtagctcctgtacttttgaaaaaggctggtgtggctggcaaaactcccaggctgacaactttgattgggttttaggggttggctctcatcaaagcttaagacctcccaaagaccacacacttggaaatgaaaatgctatcttgttgatgcgacggcataaatatcccatcagatcagttaatctgcatactgtgaagcacgtgctaaaagcacagacagttggaaattgttctgtcagcaagctagaggcgaggctattagattttctttctgttccaaatgaaaatacttttggcagctcagatcatacgaattggcacttcatgtatctggaagctactgcagtgggccttcggggtgacaaagcacacttcaggagtaccatgtggcgagaatccagtgcagcctgcaccatgagcttctggtatttcgtatctgcaaaggccacaggatccattcagattctcatcaagcgggggcggaggagaaggcgggctcccaatccggttctatccggttctcccaccatcccccgccaggggtctcagcagctcggagggtggaggggcggcagcgccaggcaccgcgcacgcgcctttccggagccagaatgcccaagaggaaggtcagctctgctgaaggggccgccacaggaaaagcctaacaggaggtcagcgctgttgtcagtgggagagatctctgagctttgtccggaaatcactgattttttgtgccgggacaagaagtgcattgcatcccaccttctttgtgactataagccagactgctctgataggtctgatgaagctcactgtgcacattatacaagcacaacaggaagctgcaattttgaaacaagttcaggaaactggaccacagcctgcagtcttactcaagactctgaggatgacttggactgggccattggcagcagaattcctgccaaagcattaattccagactctgatcacacgccaggtagtggtcagcacttcctgtacgtcaactcatctggctccaaggaaggatccgttgccagaattactacttccaaatccttcccagcaagccttggaatgtgtactgttcggttctggttctacatgattgatcccaggagtatgggaatattaaaggtgtataccattgaagaatcggggctaaacatcctggtgtggtcagtgattggaaataaaagaacgggatggacatatggctctgtgcctctctccagtaacagtccgtttaaggtggcatttgaagctgatttggatggaaatgaggacatctttattgctcttgatgacatctcttttaccccagagtgtgtgactggaggtcctgtcccagtgcagccatcaccctgtgaagctgatcagttttcttgtatctacacactccaatgtgtccctctctcagggaaatgtgatggacatgaagactgcatagatggatctgatgaaatggattgtcctctcagccccacccctccactctgtagtaacatggagttcccgtgctctacagacgagtgtataccttccctcctgctatgcgatggagtgcccgactgccactttaatgaagatgagctcatctgctccaacaaaagctgttctaatggagctctggtgtgtgcctcctccaacagctgtatcccagcccaccagcgctgtgatggttttgccgactgcatggatttccagcttgatgagtccagctgctccgatacatggactctcctgggtattggattagcattcctgatgactcacatcacagttgcagtcttgtgttttcttgcaaacagaaaggtaccaataaggaaaaccgagggaagtggtaactgtgcctttgtcaatccagtttacgggaactggagcaacccagagaaaacagagagttctgtctattccttctcaaacccattatatggcacaacatcaggaagcctggagaccctgtcacatcatctcaaatag

SEQ ID NO: 1119 - DNA, 774 bp, Homo sapiens
ctcaaatttgaaggtagagttgggaaaggtcagcgtggagacattgcacttgatgacattgtgcttacagaaaattgtctatcactccatgattccgtgcaagaagaactggcagtgcctcttccaacaggtttctgcccacttggctatagggaatgtcataatggaaaatgctataggctggaacaaagctgtaacttcgtagataactgtggagataatactgatgaaaatgagtgtggtagctcctgtacttttgaaaaaggctggtgtggctggcaaaactcccaggctgacaactttgattgggttttaggggttggctctcatcaaagcttaagacctcccaaagaccacacacttggaaatgaaaatgggcacttcatgtatctggaagctactgcagtgggccttcggggtgacaaagcacacttcaggagtaccatgtggcgagaatccagtgcagcctgcaccatgagcttctggtatttcgtatctgcaaaggccacaggatccattcagattctcatcaagacagagaaaggactatcaaaagtatggcaagaaagtaagcagaaccctggtaatcattggcaaaaggctgacatcctgctaggaaagttaaggaattttgaagtcatatttcaaggtatcagaacaagggacctgggaggaggagctgcaattgatgatattgaatttaaaaactgcacaactgtgggagagatctctgagctttgtccggaaatcactgattttttgtgccgggacaag

SEQ ID NO: 1120 - DNA, 4661 bp, Homo sapiens
atgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggagccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaataccactgatggctggtacctgtatgctgacagttctaatgggaaatttggtgacacggctgacattctcactcctatcatttcactcacgggaccaaaatgtaccttggtgttctggacacatatgaatggggccaccgttggttctctccaggtgctcatcaagaaagataacgttacttctaaattgtgggctcaaactggacagcaaggtgcacagtggaagagagcagaagtgtttttaggcattcgttcacatacacagattgtcttcagagccaaacgtggtatcagttacataggagatgtagcagtggatgatatttccttccaagattgctcccctttgcttagcccagagagaaagtgtactgatcatgaattcatgtgtgctaataagcactgcattgccaaagacaagctgtgtgattttgtgaatgattgtgctgataattcagatgagactactttcatttgccgtacctccagtgggcgctgtgatttcgaatttgatctttgttcctggaagcaggagaaagatgaggactttgactggaacctgaaagctagcagcatccctgcagcaggcacagagccagcagcagatcacactttgggaaattcatctggtcattacatctttataaagagtttgtttcctcagcagcccatgagagctgccagaatttcaagtccagttataagtaagagaagcaaaaactgcaagattatttttcattatcacatgtatggaaatggcattggggcactcaccttaatgcaggtgtcagtcacaaaccaaacgaaggttctacttaacctcactgtagaacaaggcaatttctggcggagagaagaactgtcactgtttggtgatgaagacttccaactcaaatttgaaggtagagttgggaaaggtcagcgtggagacattgcacttgatgacattgtgcttacagaaaattgtctatcactccatgattccgtgcaagaagaactggcagtgcctcttccaacaggtttctgcccacttggctatagggaatgtcataatggaaaatgctataggctggaacaaagctgtaacttcgtagataactgtggagataatactgatgaaaatgagtgtggtagctcctgtacttttgaaaaaggctggtgtggctggcaaaactcccaggctgacaactttgattgggttttaggggttggctctcatcaaagcttaagacctcccaaagaccacacacttggaaatgaaaatgctatcttgttgatgcgacggcataaatatcccatcagatcagttaatctgcatactgtgaagcacgtgctaaaagcacagacagttggaaattgttctgtcagcaagctagaggcgaggctattagattttctttctgttccaaatgaaaatacttttggcagctcagatcatacgaattggcacttcatgtatctggaagctactgcagtgggccttcggggtgacaaagcacacttcaggagtaccatgtggcgagaatccagtgcagcctgcaccatgagcttctggtatttcgtatctgcaaaggccacaggatccattcagattctcatcaagcgggggcggaggagaaggcgggctcccaatccggttctatccggttctcccaccatcccccgccaggggtctcagcagctcggagggtggaggggcggcagcgccaggcaccgcgcacgcgcctttccggagccagaatgcccaagaggaaggtcagctctgctgaaggggccgccacaggaaaagcctaacaggaggtcagcgctgttgtcagtgggagagatctctgagctttgtccggaaatcactgattttttgtgccgggacaagaagtgcattgcatcccaccttctttgtgactataagccagactgctctgataggtctgatgaagctcactgtgcacattatacaagcacaacaggaagctgcaattttgaaacaagttcaggaaactggaccacagcctgcagtcttactcaagactctgaggatgacttggactgggccattggcagcagaattcctgccaaagcattaattccagactctgatcacacgccaggtagtggtcagcacttcctgtacgtcaactcatctggctccaaggaaggatccgttgccagaattactacttccaaatccttcccagcaagccttggaatgtgtactgttcggttctggttctacatgattgatcccaggagtatgggaatattaaaggtgtataccattgaagaatcggggctaaacatcctggtgtggtcagtgattggaaataaaagaacgggatggacatatggctctgtgcctctctccagtaacagtccgtttaaggtggcatttgaagctgatttggatggaaatgaggacatctttattgctcttgatgacatctcttttaccccagagtgtgtgactggaggtcctgtcccagtgcagccatcaccctgtgaagctgatcagttttcttgtatctacacactccaatgtgtccctctctcagggaaatgtgatggacatgaagactgcatagatggatctgatgaaatggattgtcctctcagccccacccctccactctgtagtaacatggagttcccgtgctctacagacgagtgtataccttccctcctgctatgcgatggagtgcccgactgccactttaatgaagatgagctcatctgctccaacaaaagctgttctaatggagctctggtgtgtgcctcctccaacagctgtatcccagcccaccagcgctgtgatggttttgccgactgcatggatttccagcttgatgagtccagctgctccgatacatggactctcctgggtattggattagcattcctgatgactcacatcacagttgcagtcttgtgttttcttgcaaacagaaaggtaccaataaggaaaaccgagggaagtggtaactgtgcctttgtcaatccagtttacgggaactggagcaacccagagaaaacagagagttctgtctattccttctcaaacccattatatggcacaacatcaggaagcctggagaccctgtcacatcatctcaaatagcagcatcgagaccaagtctgatccaacatgtgtagtttctagaaaattgaagtctccacaatctgatagaaactcatcttctacaatggtaaaaagagaaaggattgtaaatgccagtgtaattataacatttatgaatgaattttcttgcagaatatagagaatgtttatatggaatcagaatcagtaccttatcttcactgaacatctgaatattttaataaaatttctatttaatc

SEQ ID NO: 1121 - DNA, 1761 bp, Homo sapiens; identical to SEQ ID NO: 1117

SEQ ID NO: 1122 - DNA, 614 bp, Homo sapiens
ggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaaggcgaaaccacaatttctccaaaagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtg

SEQ ID NO: 1123 - DNA, 1712 bp, Homo sapiens
aactaaactataagaggtaagcagttctcagaggagacagaaggcaacagctctaccatcctccaaacatctgaagccccccatagaaactcctcttggaattggtggttccctgtctgacccaaatgctaggccgatttcaacccttctccttggtccggagtttcagactgggatttgaagcctgctgctatccaaaccaaaaatgtgctactcagaccatcagaccccctgactccaggtgcctagtccaagcagtttctcagaactttaattttgcaaaggatgtgttggatcagtggtcccagctggaaaaggacggactcagagggccttaccccgccctctggaaggttagtgccaaaggagaagaggacaaatggagctttgaaaggatgactcaactctccaagaaggccgccagcatcctctcagacacctgtgcccttagccatggagaccggctgatgataatcttgcccccaacacctgaagcctactggatctgcctggcctgtgtgcgcttgggaatcacctttgtgcctgggagcccccagctgactgccaagaaaattcgctatcaattacgcatgtctaaggcccagtgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagctacagattcaagagtctgaagcagtgtgtggctgcaggaggacccatcagccctggggtgattgaggactggaaacgcatcactaagttggacatctatgaaggctatgggcagacggaaactggtctactctgtgccacttccaaaacaataaaattgaagccaagctctctggggaagccattgccaccttatattgtccagattgtggatgaaaactcaaatctcctgcctccaggggaagaaggaaatattgcaatccgcataaaactaaaccaacctgcttctctgtactgtccacacatggtgagctgggaggaatatgcttcagcaagaggccacatgctttacctcacaggtgacagagggatcatggatgaagacggctacttctggtggtctggtagagttgatgatgttgccaatgcattgggtcagagattgtgaatgctttggttattgctattgagcctggggctgtgggagtttgaagaagactctggactgcttccaatacgtaggaattatatttctaaagtttagaaaatgcaaacaaccaaaaataaaaaaataaaactcatccataatctc

SEQ ID NO: 1124 - DNA, 1592 bp, Homo sapiens
ctgacccaaatgctaggccgatttcaacccttctccttggtccggagtttcagactgggatttgaagcctgctgctatccaaaccaaaaatgtgctactcagaccatcagaccccctgactccaggtgcctagtccaagcagtttctcagaactttaattttgcaaaggatgtgttggatcagtggtcccagctggaaaaggacggactcagagggccttaccccgccctctggaaggttagtgccaaaggagaagaggacaaatggagctttgaaaggatgactcaactctccaagaaggccgccagcatcctctcagacacctgtgcccttagccatggagaccggctgatgataatcttgcccccaacacctgaagcctactggatctgcctggcctgtgtgcgcttgggaatcacctttgtgcctgggagcccccagctgactgccaagaaaattcgctatcaattacgcatgtctaaggcccagtgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagctacagattcaagagtctgaagcagtgtgtggctgcaggaggacccatcagccctggggtgattgaggactggaaacgcatcactaagttggacatctatgaaggctatgggcagacggaaactggtctactctgtgccacttccaaaacaataaaattgaagccaagctctctggggaagccattgccaccttatattgtccagattgtggatgaaaactcaaatctcctgcctccaggggaagaaggaaatattgcaatccgcataaaactaaaccaacctgcttctctgtactgtccacacatggtgagctgggaggaatatgcttcagcaagaggccacatgctttacctcacaggtgacagagggatcatggatgaagacggctacttctggtggtctggtagagttgatgatgttgccaatgcattgggtcagagattgtgaatgctttggttattgctattgagcctggggctgtgggagtttgaagaagactctggactgcttccaatacgtaggaattatatttctaaagtttagaaaatgcaaacaaccaaaaataaaaaaataaaactcatccataa

SEQ ID NO: 1125 - DNA, 1588 bp, Homo sapiens
aactaaactataagaggtaagcagttctcagaggagacagaaggcaacagctctaccatcctccaaacatctgaagccccccatagaaactcctcttggaattggtggttccctgtctgacccaaatgctaggccgatttcaacccttctccttggtccggagtttcagactgggatttgaagcctgctgctatccaaaccaaaaatgtgctactcagaccatcagaccccctgactccaggtgcctagtccaagcagtttctcagaactttaattttgcaaaggatgtgttggatcagtggtcccagctggaaaaggacggactcagagggccttaccccgccctctggaaggttagtgccaaaggagaagaggacaaatggagctttgaaaggatgactcaactctccaagaaggccgccagcatcctctcagacacctgtgcccttagccatggagaccggctgatgataatcttgcccccaacacctgaagcctactggatctgcctggcctgtgtgcgcttgggaatcacctttgtgcctgggagcccccagctgactgccaagaaaattcgctatcaattacgcatgtctaaggcccagtgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagggtctactctgtgccacttccaaaacaataaaattgaagccaagctctctggggaagccattgccaccttatattgtccagattgtggatgaaaactcaaatctcctgcctccaggggaagaaggaaatattgcaatccgcataaaactaaaccaacctgcttctctgtactgtccacacatggtgagctgggaggaatatgcttcagcaagaggccacatgctttacctcacaggtgacagagggatcatggatgaagacggctacttctggtggtctggtagagttgatgatgttgccaatgcattgggtcagagattgtgaatgctttggttattgctattgagcctggggctgtgggagtttgaagaagactctggactgcttccaatacgtaggaattatatttctaaagtttagaaaatgcaaacaaccaaaaataaaaaaataaaactcatccataatctc

SEQ ID NO: 1126 - DNA, 1790 bp, Homo sapiens
aactaaactataagaggtaagcagttctcagaggagacagaaggcaacagctctaccatcctccaaacatctgaagccccccatagaaactcctcttggaattggtggttccctgtctgacccaaatgctaggccgatttcaacccttctccttggtccggagtttcagactgggatttgaagcctgctgctatccaaaccaaaaatgtgctactcagaccatcagaccccctgactccaggtgcctagtccaagcagtttctcagaactttaattttgcaaaggatgtgttggatcagtggtcccagctggaaaaggataatggccttcagctccatccatgttgctgcaaaagacaggatttcattcttttccatgggtgtcttttttatatagacggactcagagggccttaccccgccctctggaaggttagtgccaaaggagaagaggacaaatggagctttgaaaggatgactcaactctccaagaaggccgccagcatcctctcagacacctgtgcccttagccatggagaccggctgatgataatcttgcccccaacacctgaagcctactggatctgcctggcctgtgtgcgcttgggaatcacctttgtgcctgggagcccccagctgactgccaagaaaattcgctatcaattacgcatgtctaaggcccagtgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagctacagattcaagagtctgaagcagtgtgtggctgcaggaggacccatcagccctggggtgattgaggactggaaacgcatcactaagttggacatctatgaaggctatgggcagacggaaactggtctactctgtgccacttccaaaacaataaaattgaagccaagctctctggggaagccattgccaccttatattgtccagattgtggatgaaaactcaaatctcctgcctccaggggaagaaggaaatattgcaatccgcataaaactaaaccaacctgcttctctgtactgtccacacatggtgagctgggaggaatatgcttcagcaagaggccacatgctttacctcacaggtgacagagggatcatggatgaagacggctacttctggtggtctggtagagttgatgatgttgccaatgcattgggtcagagattgtgaatgctttggttattgctattgagcctggggctgtgggagtttgaagaagactctggactgcttccaatacgtaggaattatatttctaaagtttagaaaatgcaaacaaccaaaaataaaaaaataaaactcatccataatctc

SEQ ID NO: 1127 - DNA, 1062 bp, Homo sapiens
aaccgcctggagccgccgggagtggacgccgccgaggcccggagtcgcgcctgcagacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaacaggggccatggtgctcccccagggggtcctggcccccgccagcagcaggcaggtgccaggctgggtgctgctcagtcccccttcaatgacctcaaccggcagctggtgaacatgggctttccgcagtggcatcttggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccaagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaa

SEQ ID NO: 1128 - DNA, 403 bp, Homo sapiens
gccagggccagcgggcttcaggagggggacgcgcctgtcccgggctccaggctacgggcaagaccacagggctcctgacctttttcggcatacatgtcaccagtgctatctggaatacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaacaggggccatggtgctcccccagggggtcctggcccccgccagcagcaggcaggtgccaggctgggtgctgctcagt

SEQ ID NO: 1129 - DNA, 1923 bp, Homo sapiens
gggggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaaacatcacggctgcagccctggctacgggtgcctgcatcgtaggaatcctctgcctccccctcatcctgctcctggtctacaagcaaaggcaggcagcctccaaccgcctagctcaagaacttttggctcaggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatgggg

SEQ ID NO: 1130 - DNA, 4689 bp, Homo sapiens
ccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtccctaggcagaggggggtcccttcttttgttccctctggtcaccacaatgcttgatgccagctgccataggaagagggtgctggctggccatggtggcacacacctgtcctcccagcactttgcagggctgaggtggaaggaccgcttaagcccaggtgttcaaggctgctgtgagctgtgttcgagccactacactccagcctggggacggagcaaaactttgcctcaaaacaaattttaaaaagaaagaaagaaggaaagagggtatgtttttcacaattcatgggggcctgcatggcaggagtggggacaggacacctgctgttcctggagtcgaaggacaagcccacagcccagattccggttctcccaactcaggaagagcatgccctgccctctggggaggctggcctggccccagccctcagctgctgaccttgaggcagagacaacttctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggactgctcagcactccctaaaaacacaccatggaggccactggtgactgctggtgggcaggctggccctgcctgggggagtccgtggcgatgggcgctggggtggaggtgcaggagccccaggacctgcttttcaaaagacttctgcctgaccagagctcccactacatgcagtggcccagggcagaggggctgatacatggcctttttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccatggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgact

SEQ ID NO: 1131 - DNA, 2074 bp, Homo sapiens
ggacggctggggagctcccagccaactctgtgtctgggtttttcaagaggatggtgaagtcggaggccagcaatgcggctaccgcctatttccgtccagcaagacccttgccctctctggtcacagtcctggggctgggctacttcgcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctggtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctctagctgaa

SEQ ID NO: 1132 - DNA, 481 bp, Homo sapiens
ttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcaaaatgagctaagaatacggataaagatgagaaaactgattctgagagattctgagtgatttgcccaggtcacagctggcataaaggcatcacaagtggtcgggctcagctactctggttcctacagactttcttctttgggatagcgtctctcaccatcttgattgcttacaaacggaagcgccaaaaacaaacttgaagttgtctgaaagcttgctct

SEQ ID NO: 1133 - DNA, 860 bp, Homo sapiens
cggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaaatgagaaaactgattctgagagattctgagtgatttgcccaggtcacagctggcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccac

SEQ ID NO: 1134 - DNA, 342 bp, Homo sapiens
gaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcaaaatgagctaagaatacggataaagatgagaaaactgattctgagagattctgagtga

SEQ ID NO: 1135 - DNA, 2042 bp, Homo sapiens
gaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctggtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctctagctgaa

SEQ ID NO: 1136 - DNA, 719 bp, Homo sapiens
agagtttcttcggtctgtgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttc

SEQ ID NO: 1137 - DNA, 2877 bp, Homo sapiens
tctgtggaactcccactggatgcagatgtacagaccagtaatctactgataacctttttaaagtatagctcaattgtcatgcaggacaccaaagatgaacacaggcttcacagtggcaaactctgtctgattatccttacatgtattgcagagcctatgagacacaggaagaaggcagcagacaagaatcttccctgccgtcctttagtatgtgcagtactggacctgatggtagagtttattgtaacacacatgatgaaggagtttcctatggatctctatatacgctgcatccaggtagtacacaaactgctctgctaccagaagaagtgtcgggtacgcctgcattacacctggcgggagctctggtcagccttgataaatttgctgaagttccttatgtcaaatgagactgtacttttggccaaacacaacatttttacattagcccttatgattgtgaacctatttaatatgtttatcacatatggcgacacatttctgccaacccccagcagctatgatgaactttactatgagattatccgcatgcaccagagctttgacaacctctactccatggtcctgaggctttctaccaatgcaggccagtggaaggaagcagctagcaaggtgacccatgcattggttaatatcagagccatcatcaaccactttaaccccaaaattgagtcctacgctgctgtgaatcacatatcccaactgtcagaggagcaggtgctggaggtggtgagagccaactatgacacgctcacgctgaagctgcaggatggcctggaccagtatgagcgctactcagagcagcacaaggaagctgccttcttcaaagagctggttcgatccattagcaccaacgtccggagaaacctggccttccacacactcagccaagaagtcctgctcaaggagttctccactatctcctgaggccacgcctacctgagcagcctctgactgcccttacccatgaggatcatgggctggagggggagcgaggggagagggggctgcccccgaggttggagagaaacacagataccaagttctcttggtgaagaccgcacttcaatggagcttgggcagcaggggcaggagggtcaagccagggataatcttatttggggaggaatgggtgggcacagtggggagaggcctccaggaatgtggggacttccagagtgggctccctaaacagcccctcacatttccaatcttgaggttacaagctgtagctactgactaattttcgggagctggtgaggcaagcctcagggtaatgccagcaccctgaaagtcagtggctctgctcggcttctgaaaacagatcaactctcagatatagctggagctacatcctgcttcctttgggcctggggctgtgcttggcttgaaatctgtgtcccctgcctgcactggcactttgtccagtcatcgggacctttggctcagatttagggtaagataggaatagggtacctttttccttttttttctgagacggagtctcactctgtcgcccaggctggaatgcagtggcgtgatctcggctttactgcagcctccgcttcctgggttcaagcgattctcctgcctcagcctcccgagtagctgggactacaggagcgtgtgccacgcccggctaattttttgtatttttagtagagatggggtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgactcatcagcacaatagggtcaccaccttaacttttaatttctaatctgctttactgtctttagggtgtgtatgaaataaacattgacaggctttctggagccctcaaggtgcctactttgctggttccctttccagcagctcccccacctcccttagccccccctcctctggcagcctctcctgcctctgctgagctcccctccacgtgttccacccccttaccctgctgttgtttacatccaacctgcctgagaatttcctctggggaggaatctattcctgtcatggtctagtgcctgggagggagagaactttctgggggtagggtgccctccatctgaaacaggccaggtgagcatcatgcataaggcctccattctgtccgctcagattctgggtggggccacaggcaaatctcctgacttatggggagttggcttgtggttcctcccttggatagcctccatggaaccactataggctttcccaacagctgcctctgaaatagctgctgcttcgagatcctccctttttaaagcactttctaaagccctcaggatggcgggagcaaacagcactggtatattctaggagtaagtgcaggaattcagcagtgagagcatgtctgggaccacctggactgccatccatttaacctcaaatctctttgggatactcgccctccctgggaaccagagttctggctctaacattgagcagctatgcactagttccagagaagccactaacaggctgccatgtgtagatgtaggttcttaagagatcacaggctgggtcatctgatcactggatggatagctcagcctggggcatttagtgttttccctggtgataaatccccaaggcagctggatttggagctggtggcaagttgaaattattaaaaattgatttgtgtgggactgtc

SEQ ID NO: 1138 - DNA, 724 bp, Homo sapiens
gggaggtcgggagcgcgcccgtgagcccggagcagcggcagcgtcggtggcgtcgagagcgagcgggcccgggaacggcgcgggtggtagaggaggagccgcgggctcgattctctaaccatggcacaggtagagaaacgtggaggtttgctccggaaatcttcagcctccaaaaaaccactgaaggaaaaagtggtgctgatgtatgatgagatcttcatgacagaggaccccagtaagtgcagtcctcggttttgggaggagctctttctcatgaaggtgaatttagagtacctagaaggcaagctggaatctcttgatggtgaggagttaatgaagatcaaggacaatattaattgcttattccaacactgcatccaggctctgggagaggagcatccaattcgggttgtcaatgcattgcagaccctgtgcgcactcattcgaggagtccatcaaaagaataagtctacctctgggtttgacattatcaacatgctgatgggctttgacaaggcggagctgtgcatgaaggtgaggcataagctgcagatgtgcctgtggatggcagcttctgacagctgttcctggacactatcagcagacaaatgtactcaaagatttggactcagaaagatacagatgattgaatttggccttgcatttagatgtttttatttcacagatttgctttatctgaataaaggaaaattttaaattcaaa

SEQ ID NO: 1139 - DNA, 4119 bp, Homo sapiens
gggaggtcgggagcgcgcccgtgagcccggagcagcggcagcgtcggtggcgtcgagagcgagcgggcccgggaacggcgcgggtggtagaggaggagccgcgggctcgattctctaaccatggcacaggtagagaaacgtggaggtttgctccggaaatcttcagcctccaaaaaaccactgaaggaaaaagtggtgctgatgtatgatgagatcttcatgacagaggaccccagtaagtgcagtcctcggttttgggaggagctctttctcatgaaggtgaatttagagtacctagaaggcaagctggaatctcttgatggtgaggagttaatgaagatcaaggacaatattaattgcttattccaacactgcatccaggctctgggagaggagcatccaattcgggttgtcaatgcattgcagaccctgtgcgcactcattcgaggagtccatcaaaagaataagtctacctctgggtttgacattatcaacatgctgatgggctttgacaaggcggagctgtgcatgaagaacttgatggagagtttggattcattgctttgtgcagaaggttctgaaagtctgaagagtttatgtctgaaacttctcctttgcttagtgaccgtgacagataacatcagccagaacactattctcgagtatgtaatgatcaacagcatatttgaagcaattttacagatactttcccatcccccaagtcgtagggagcatgggtatgatgctgtcgtcctcttggctttgctggtgaactatagaaaatatgagtctgtgaatccttatattgtgaagctgtctatcgtggatgatgaggccacactcaatggaatgggacttgtaattgctcaggctttatctgagtacaacaggcagtataaagacaaggaagaagaacaccaaagtggttttttctctgctttaacaaatatggtgggcagcatgttcatagcagatgcccatgagaaaatctcagtacaaaccaatgaggccattcttctggcactttatgaagctgttcatttaaatcgcaacttcatcacagtattagctcagagccatccagaaatgggcttggtgacgacccctgtcagtcctgctcctacaaccccagtcacaccacttgggaccacaccgccttcctctgatgttataagttctgtggaactcccactggatgcagatgtacagaccagtaatctactgataacctttttaaagtatagctcaattgtcatgcaggacaccaaagatgaacacaggcttcacagtggcaaactctgtctgattatccttacatgtattgcagaggatcaatatgccaatgcatttttgcatgatgacaacatgaattttcgagtaaacttacatagaatgcctatgagacacaggaagaaggcagcagacaagaatcttccctgccgtcctttagtatgtgcagtactggacctgatggtagagtttattgtaacacacatgatgaaggagtttcctatggatctctatatacgctgcatccaggtagtacacaaactgctctgctaccagaagaagtgtcgggtacgcctgcattacacctggcgggagctctggtcagccttgataaatttgctgaagttccttatgtcaaatgagactgtacttttggccaaacacaacatttttacattagcccttatgattgtgaacctatttaatatgtttatcacatatggcgacacatttctgccaacccccagcagctatgatgaactttactatgagattatccgcatgcaccagagctttgacaacctctactccatggtcctgaggctttctaccaatgcaggccagtggaaggaagcagctagcaaggtgacccatgcattggttaatatcagagccatcatcaaccactttaaccccaaaattgagtcctacgctgctgtgaatcacatatcccaactgtcagaggagcaggtgctggaggtggtgagagccaactatgacacgctcacgctgaagctgcaggatggcctggaccagtatgagcgctactcagagcagcacaaggaagctgccttcttcaaagagctggttcgatccattagcaccaacgtccggagaaacctggccttccacacactcagccaagaagtcctgctcaaggagttctccactatctcctgaggccacgcctacctgagcagcctctgactgcccttacccatgaggatcatgggctggagggggagcgaggggagagggggctgcccccgaggttggagagaaacacagataccaagttctcttggtgaagaccgcacttcaatggagcttgggcagcaggggcaggagggtcaagccagggataatcttatttggggaggaatgggtgggcacagtggggagaggcctccaggaatgtggggacttccagagtgggctccctaaacagcccctcacatttccaatcttgaggttacaagctgtagctactgactaattttcgggagctggtgaggcaagcctcagggtaatgccagcaccctgaaagtcagtggctctgctcggcttctgaaaacagatcaactctcagatatagctggagctacatcctgcttcctttgggcctggggctgtgcttggcttgaaatctgtgtcccctgcctgcactggcactttgtccagtcatcgggacctttggctcagatttagggtaagataggaatagggtacctttttccttttttttctgagacggagtctcactctgtcgcccaggctggaatgcagtggcgtgatctcggctttactgcagcctccgcttcctgggttcaagcgattctcctgcctcagcctcccgagtagctgggactacaggagcgtgtgccacgcccggctaattttttgtatttttagtagagatggggtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgactcatcagcacaatagggtcaccaccttaacttttaatttctaatctgctttactgtctttagggtgtgtatgaaataaacattgacaggctttctggagccctcaaggtgcctactttgctggttccctttccagcagctcccccacctcccttagccccccctcctctggcagcctctcctgcctctgctgagctcccctccacgtgttccacccccttaccctgctgttgtttacatccaacctgcctgagaatttcctctggggaggaatctattcctgtcatggtctagtgcctgggagggagagaactttctgggggtagggtgccctccatctgaaacaggccaggtgagcatcatgcataaggcctccattctgtccgctcagattctgggtggggccacaggcaaatctcctgacttatggggagttggcttgtggttcctcccttggatagcctccatggaaccactataggctttcccaacagctgcctctgaaatagctgctgcttcgagatcctccctttttaaagcactttctaaagccctcaggatggcgggagcaaacagcactggtatattctaggagtaagtgcaggaattcagcagtgagagcatgtctgggaccacctggactgccatccatttaacctcaaatctctttgggatactcgccctccctgggaaccagagttctggctctaacattgagcagctatgcactagttccagagaagccactaacaggctgccatgtgtagatgtaggttcttaagagatcacaggctgggtcatctgatcactggatggatagctcagcctggggcatttagtgttttccctggtgataaatccccaaggcagctggatttggagctggtggcaagttgaaattattaaaaattgatttgtgtgggactgtc

SEQ ID NO: 1140 - DNA, 284 bp, Homo sapiens
tctgtggaactcccactggatgcagatgtacagaccagtaatctactgataacctttttaaagtatagctcaattgtcatgcaggacaccaaagatgaacacaggcttcacagtggcaaactctgtctgattatccttacatgtattgcagagcctatgagacacaggaagaaggcagcagacaagaatcttccctgccgtcctttagtatgtgcagtactggacctgatggtagagtttattgtaacacacatgatgaaggagtttcctatggatctctatat

SEQ ID NO: 1141 - DNA, 468 bp, Homo sapiens
ttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaagagctgcaatgggatggatgcgtgagcctccaaggcacagcccagggaagcctccccagagtcaggtaacaaccagatggcttcactgaaacctgcttttgtaaattacttttttttactgttgctggaagtgtcccacctgctgctcataataaatgcagatgtatagca

SEQ ID NO: 1142 - DNA, 575 bp, Homo sapiens
gccgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcagtcctgtctggggcccattctgcaggggtggtgggtgctgggacctacattgcttccccaatctcttccctttcccatttctcatctgcctttcacagttcctgctgctgatctacttaagggggatgagatttgtgtagcaccggtgttttgtcattggaatttaa

SEQ ID NO: 1143 - DNA, 2714 bp, Homo sapiens
ctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacga

SEQ ID NO: 1144 - DNA, 5884 bp, Homo sapiens
gaagcggcggcgaaggcggcggcggcggcggcggcggcggcagcagcgcggctcggtctctggtccattcactccacgctttctgcagccgccactgcagccgcgcggcgggggctccctccttgcagccagccggcggtccagcctggtgcctctgcaaaggaaaggggagcgtggagacgtgttcgaggtggtatcggcgaggatctctcgggcgccgctcactccttggtcgccttgcttgccagcagttgctcccttagtccttggctcgctcgcacaccccctcccgctacagggagcagttttgggtggcgtgggctccgtcctcttcttggctggtaggaacggtgtgcccaagaggggaagcctagtgggcctggcccctcccagccccgcgccaatgagtgccagggcgccgaaggagctgaggctggcgttgccgccgtgtctcctcaaccggacctttgcttcccccaacgccagcggcagcggcaacacgggtgcccgcggcccaggcgcagtaggcagcggcacctgcatcacgcaggtgggacagcagctcttccagtccttctcctccacgctggtgctgattgtcctggttaccctcatcttctgcctcatcgtgctgtccctctccactttccacatccacaagcgtaggatgaagaagcggaagatgcagagggctcaggaggaatatgagcgggatcactgcagcggcagccgcggtggcggggggctgccccgacctggcaggcaggccccaacccacgcaaaggaaacccggctggagaggcagccccgggactctcccttctgcgccccttccaacgcctcgtcgttgtcctcttcgtcccctggcctcccgtgccagggtccctgtgctcctccgcctccaccgccagcctccagtccccaaggagcacacgcagcttcctcctgtttggacacagctggcgagggccttttgcaaacggtggtactgtcctgatcgtctagcccctctcgttccccgtcctcgtttccagcatctttgccacccttgcttttttccttcttccttccttttccattttcctctggcccctctttcctcttcctggtttccttacctgccctccccttactcttgtttctcctccgccgaggcactgtgcggtatttgtaaatattgggcgaggaaagtctcggaagaagaaataacgctgataataatactttattaatatttatagtaattattataatactaataacacaatccaagcgcatgacaaatcacataatttctaactgtcaatggaggatgcatcttcccattccaccccgcgctcccctcaattaggaggagaaaccgcacaagctaccaaatatataaaaggcattgattcccggagcaaagggaggggagggggcccggtaatgtacatagctgtcaagttaagatttagtttccttccttcccctctgacccctaagctttcacttttcctttagcttccctttcctccccattcccaccctcagccgggctcaggcaatagtatattataaagaaaatgtctacattaagcaccaggactgcaagaggccatagagaatagtccccggaaagtgtttatgacaggtacccctcgccagtccgcccatttctcaccctttggttaaccattacattttccaggacagagcatttaatttactttttaaaatgaccctcgctggccgagcataagtacgttaaaatctttaaatgagttttttttaaaaagctaacgctttcattccctgccccgcccccacccgtacacctttgacttgtgacattttcaggatttacaaaggatctgggagctgtccagccaggtctggtgctgaagtcgcctcaccgttctgattacttcctctagttgtgaaggcagaggaggggctgttttggaaagtgactattctggcttttggttgggttctttcttctttttctacaatcgagttagcgtgtactattggttttcttattattaaacattgcataagttaccttttttgtaaaaaaaaaaaagtattaggtgatgtgcagtactgaaagtgcagtatctaaccaactagaacgtttgttttatttttagaacaagtgcacctttgttatatatttagtatattggtaccaaatacagaaaaaaactatagttctgtactatgtcctccaaactgtatattattgttcttaatttccagctgttgatataatggttaccactggatgagaaattcagtggtgcagacctggcttctgctgtttccagaagtgttcttttgtaccttattctgtagtagactgttataaaaagatgacacacacgctttattttttcttttgcaaataatagaaaaaacacaaccacagaaacaaacaaataatggatgtgcaagaatgccatctattaaaaacatggttaatatttaaacagtgcctgtagttctccctgcatgcagttaccacctggaggcagtggtgtgtgtgcttgcttgtactgtatgtggttggggatgagactggtggggatgttgggcaatttggatgataagacatgcgaatttcaagaaaagctagatccagtaattacttataggatacaaatgtttgcagcttgtttgtttagttacaaatctgtgcctgcagcaaaagaaaggctctctttctcagtctgtcctaacttcactgaacatacaaaaatactgagaaaaaaagaaagtgagaaaataagataaatattttattattttctaatgccagacaaggccatctatgttagaaatggaagtagtctatagttatttaccaccttgtttcctttggttgaatgacagaagaagccagaagcatattacaatattaattatatgcagtgacatctcttcttggaaatcaagcctttgacagctattcaaatttttggaaaatgtatgaatgaaagtgatctgcaaaaagctctaccaagagagtccttactatcctgcagggtgtaaggcaacagtgcccctatgagcatccctctcccaagcaactcattgttctaaattgtctacttggtccagacatatgtgctcttatccagaggaaacattacctctaatatttttggtcatctattaaattgcccaagctcagtttgcatcttttataaaaataatttaataaacttaattttaatcacccataagataatcacctttcctgaagcacagaagatcatcattgaagcatgccatcttgtaatattaggaagaccaggtataatctttgggtacaatatattaaacaatgaaccagtttttctccagtgccttagtcacttcctagtaataggtaaaagagtgcattaactccctcaggccactagggaatcctgtagtgcatcagagttctacactgtacatcagaatgactaaggcactgtgaagaagaaagtccattgatttttgtagcttaccctcatccagtggtagctctttaataccttattacagaatgacttttggacttgaaatttgaatagaatcagggtcccagaagggagcttcatcatttccaatgagctccaataagtgcatggatattactttctttcccttatttggtgcactttctacagcgaataatttcccattttattaaagcaataagatgttctgttgtgagcagtgctggataacgattccattttcttggtgctgaagctacgcatatgttcttgccttatgaatcatagtatattcaaggcatgcaataataatccccttccaaggagcagcctgtacactctgtgggggtaattatgaaattgtcctacatcatttctccccaaaggaatgcaaggagcaagagaaataaaagcattatgtatattgtaaaacaaatgatctcaatacctctcaacgtgggcacacatctgtaatacacttttattgtgcaactttaaatgtgtgtgcctttctccattaattgactgtagtttaatatttttaatagtgctctgtgtaaagatgatgcagtttgtgagtcagatttcatactgagcttaatatactcaaaacctaagcttccagtggtattacttgtgatttttttatgagatagagaattacatgaaattctagtaatccagtttccacacaaaattatttcaataagcacatatccaagcaatttgtacagaccttgtttaaagcactgcttcttatagggctcaattggcagtctcaggagcttgggatgctaccaacagggcatttaggttttcatttttatgaaacaaaaggcaatctggaaatagctaaatttattttaaggattttattcactgatgtcccgtcaaactaaatgcttcaaacccctatagctacagcttaacttctgcacttgctattcagtattaataaggtggcatgcttgattcttattgtttttaaaaatgagaaaatttggagagagaatactattatgtcaacggtacaagactctgaatcttgaagatgtagatggatataatatttagactttatatacacccatagatatgtatttatatatgcatacgttttgtataaatttacaattgactttttgtattctcttttctgtcattacaagaatgagatggaaaccaaaatagttgttccatcctcttacccaaagaggatactgaaaagtccggtatgtgcatgcacttgtttctctggggtcaaatctgaatgactttctctttaataatgaaaggggagagtcctggttagcttggaaaattggtaattagataagcttcctttcctaggttagtgactcaaatgtagcaatgataataaagttatgaccatatcaatgtggtctaaatatctagatggaaagcaaaaatatccagaagaggtttagggccatctagaccacaaacctggaacctggattgtggtttgatttttttcattttcaacctatatgttgtgtagaaatacaatttatatctgcatagctaaaggtaaagtgaaaatatgaccattatctgtttagtttgagaaatcatttttggataatatggataaattagctttaagaaacttctttgacatctgacttttccaccatttctatctgtatcaattgtattaattagataatggttaaatttttatttttttatcatgtagacatatgctttcatgcttttctgtgggtgaaagttgaacaattgctagctgatattatgtggaagttacaggttaaagtagaaccagaaattttaatataatctgatcaggttccttagtcccattcccatgtgaatctgaactttgaatttgaatctgaaaggcctacttatttgggccattttttgttggaacttgtgattgtaactcacagatgtttcagttcatattagaataaattgcccaatctataagagagtgtttaatcattggaatgaatgtaaatctgattctgatttggttatttatttgataacatttgagaaacagctaatgtggcttgacatcaatacttattaatgtcttcaacctaataatacaattggtgtcatgtatgaatgcttagctgacaataagaatttaatcaactttatttggagacaatgacttatcaaggaggtcctacccatttgtggtagggatatttcccttacagttgtgattacaagggattgtttctatagagagatgaacagcaacaacagtgacaatgatgacaacagaaaaactgacttttgaacttgagtatatccaatagatagaagaaaaaagatattagaattcatggaaattttgttttgcttttctatcaataaaagagttttcttgttaa

SEQ ID NO: 1145 - DNA, 1192 bp, Homo sapiens
tggcgcttcctcttccgggtcggcgctcctgcctccctgcagggagctgcttatgggacaccaattcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcactggcggtcaccacacccgagagggtgccttgagcatggcccgtgccaccttggcccagcgctcatacctcccacaaatctcctagtctaataaa

SEQ ID NO: 1146 - DNA, 1010 bp, Homo sapiens
gggagctgcttatgggacaccaattcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcactggcggtcaccacacccgagagggtgccttgagcatggcccgtgccaccttggcccagcgctcatacctcccacaaatctcctagtctaataaaaccttccatctc

SEQ ID NO: 1147 - DNA, 3362 bp, Homo sapiens
ggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgtttgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaa

SEQ ID NO: 1148 - DNA, 833 bp, Homo sapiens
agtgctgggtgtacaacgtggagcggagggaggaggtgccaagctcagtgctagccacggcgcctccagggtcattttctgcctcctgccacgtcactcactgctaaagaaaaaaaaaagatttgctagtgcctaaagggatcagtagggagagaaggggccacccggaagggtttagaaacacctagagaaaagggaagggttcttaatttgatttttgcgtccttgtgaacactgtgctaattccaaatgaaaatatttgctatatgtgattatttgctgtatgctattgtttagcctttgaaacttctgctggtgtgagtgccctcaggggttccccaggaatatcgatacaacaccaacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgc

SEQ ID NO: 1149 - DNA, 811 bp, Homo sapiens
ctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacaggctggagtgcagtggcttgatctccactcactgcaacatccgtctcccaggttcaagagattttcctgcctcagcctccctggtagctgggattacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattg

SEQ ID NO: 1150 - DNA, 3349 bp, Homo sapiens
gccggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgtttgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagg

SEQ ID NO: 1151 - DNA, 925 bp, Homo sapiens
acgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacagtcttgctctgtcgcccaggctggagtgcagtggcttgatctccactcactgcaacatccgtctcccaggttcaagagattttcctgcctcagcctccctggtagctgggattacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttc

SEQ ID NO: 1152 - DNA, 1483 bp, Homo sapiens
tttattaaatgccgcagtttgaagtaggagagaaacaagatgaagactagttgtatagtgggtacaaaatgttgtttatctgaataatgttgatgaaatcgcaatttagcatgtgataagaggtagtctcacatgttgaggttaaaatgaaatgtgtttgtatgttttttttttaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacacccc

SEQ ID NO: 1153 - DNA, 15336 bp, Homo sapiens
gcggccgctgactcggcgcagtggctctcggtgaaggaagagaccatcttcctgcacgacgggctgatccgggtcaccgacctggccgagctgcccagcgagatcctcggggccccagaggccgcggacaccgacctggagattttaacctttgagaccaagaacccgtcggaattagcagaacgtttgcgctctgtttgtgggaatcagagcaatgcctatgcccggctgctggaataccgcctgaatgccttgcgaggactgtggaatgcccagcgccagctggccttagaagaacagcatgaaagggaaagttcaggtgatgaggaaactttggccctgctcaaacgccagggcttgttgcagcaacctgagcaagcgcccttcacatcgaggatggggctcctgctggtcttcccccttattcagtcccagagtagaacagacccctctctctgtaacataactgctgaggtgctattgaactgccttcgtgactgccagcctttgagcttgaccaaggagcctgctgactgtctcaatggaattgaaactttgctgtgctcttggctagaggagacttctgacacaggccgacacatcccacataagcaaaaagaaaatgctgctgctgccctggtggctttggcttgtgccaggggatcattgaaaactttcgtccacacagtccatctattacagaaacagacggatctagggtccctgcctgtagctgatgtgctatataggctgttgcttttggaaggggggcctggatctccctcctgtttgcttgggggcaaacacatagtatcatggggttatgaagacatgttgcctgcgccggatagcaacactggctccagttctgaaaataaagatgctgacttgggacgctgtctcacggcagatggtctttacctgtatactactaactcagttggaagaggagtaagcaaattgggatctggattacatggtactctcagaggttttgtgtactgccggaacgaggagttggaaccaggatgggtggcttttggcagcggcagtcttctccaccggcctgtctctttcgataataaacctcactcccttttccaggtcattgaccagaacacccttcaggtgtgccaggtggtgccaatgccagccaatcacctccccattggcagcaccatgagcactgtgcacctgtcttcagatggcacttacttctattggatctggtctcctgccagcctgaatgagaaaacaccgaagggacattctgtcttcatggacatttttgaacttgtggttgaaaatggtgtatttgtagccaacccacttcaggaacgtacaattctaatgagaaaagagggcgaatctgccaaaagcattaatgagatgcttctaagtagactttctcggtatagagcctccccgtcagcaacgcttgctgccctgactggttccaccatctccaacacactgaaagaggatcaagcagcaaatactagctgtgggctgcctctaaaaatgctgcggaagacacccatatatacctgtggcacctacttggtgatgctggtgcctcctccagggggatcaggcagctctgccacccgatctctttttggtggaacaagtggtttgtcatctttaaaaagagcgtgttatgacacagtgaacaacatgctatggacatgctcaaatgactatatcgatcagtggtgtaaccctgggaatcaagccttccattatgtctgccagagacttggagtcagtcacattatcactgagcccaaagaagaggctataaccacgaatgaggttataaaccaattattgcaccacgttggtgcgatgtgcatacaccaactcaatcttcttgccaccaaccccaatcttccaatcacaagtgtcttgggcaagcagcatccaattgaagcacatcatcttagcagtatttgtgacattatggagaaggccatggttaatggagatacctgtattatacgctgcattctcgttgtctttcaggtggtatttaaatttttcttcagcccacaaactgaaaggaatcgagacatcattcgacggtcgggattgcttctttggcagttgttgatggctccaaaagatcaaatttgccctgaaattcagaaggaagtctgccttgccatcagctctggtttaaatatcttgtacccaggtgaaactgaaatcaataacttacttaaactggtcttaacagaaggagagagaaacagtggactctcccagctacgggatgtgatcctaaccaacctggctgaacagctccaaaacaaccgatttggcagtgatgaggatgatcattacagactaaatgatgaacttttacactacattctgaagattgttgtacgagaatcctgtatcttaatcaccaagtgccaaactgtctctaaagatgattttcaaaagctcctttcaactgtgcctgctgcatcctcctgcctgcgctatctgatggcagttcagaatcaccttctcagtaacactattttgattaaacctgatgagaatgatgacagtgacagctccttgcagggagagacattgaaggtacaggagctaaaagtcagtattttggctcttgccacccaaatcctgactggatgtgatgaagtgttggaaatgctacagcaggtcacaactgccctcataaatagtgacatagcagaccgtgagcagaggttaaaaggcttggaacaagttactaaggctactatgcttggtcaccttcttccagtgttactgacctccttgatgcatccaaatttacagactctgatcatggcggatgccctgatgcctcagctagtgcagctggtactctataccagccagacggcgttgctgcttaaaacccagtgtccggtttttgctgaggtgggctgttccccgtgtggtgcaccagaccagaagtgcaggctgttccctgatgagagaatgttagaagagaaggaagagccaggatttctcactggtttaaagattcctgccccatgggctgctggaaagactgtggaaacagtccaccccgtcagagacaactataaatttaaagaaacggtccatatcccaggagctcgctgcctgtaccttagatttgatagcagatgctcttcgcaatatgactatgacaaattggtgatatatgcggggcctaacacaaacagtaggaaggttgctgaatatggaggcaacacactgggatatggcagccgtagtgtcttaggaactggttggccgaaagacttggtgaagtgcatttcccccccttccttaaattttaaggtggaaggagatacagtcaccttctcctttgaaatgagaagtggccgtgaacacaacactcctgataaagccatgtggggctttgcttgcacagttcgcgctcaggagtcttcggaggatgtctcaggaggcttgccctttctggtagacctggctttaggtctgtctgtgttagcttgttccatgttaagaatcctgtacaatggaccagaaattaccaaagaagaagaagcctgtcaggagctattgcggtccaaacttttacaaaggtgccagtggcaggtggaggccaatggcgtgatctcccctgcccttactccgagcccctctccactgcctctgaccatagaggaagacagagaattcacctacccctctgatgtcctcgtgcctcctgttggaaactactttgatctgcctcggatcagactgcctccaggaatcatgataaagctcagggaaatttctgggcgtgctagacctcaatttagaccaagtataaaagaagtgattcagccagacgtgatggaggaaatggtggtatcttgtgttattaagcacttgaacttggttgatgcactgcagtctctaataaatttccaatatcaagaagaacatgctgaagaatatgatttattatgtaaaattatgggagagacctttaagaaactcaatgccatggagagacagctgcagagtgttgcagaactggaacaaaaatggcaaagtgaagttgatgatgccatgcaggggaaactggagaacaacatgcctttcttttatgattaccattttaatgagaacaaaatgaaagaactagaacttttatgttcaatgaaggaagtctcctttgatgggaatgatcttgaaaacatggtcctatcactgagggagaagttcctacaagaagtgaattctcttattcagaaaccctcacacccactggctaaaacaaagacgttagtgaagagtttaatgaaccgagccgagctgttgctgcatgtcaccatcgcagcccagtcgggcctcacgagaagcatctctgggacccctgctgaaacaccagcttgtaaatcagcttctgaaacaaaagtgatatctcacgctgtcaggcagcctgtttttcttcgcagcatgtcagctccttctgacctggaaatgattggtaatgaagatttggaatttactagagcaaatcagaggcgtcgccacgtgaccagccaccgcagcagctcctttacactcctgcagtcgctggccattgaggacagcagggacaagcccacctacagtgtcctgctagggcagctgtttgctttcatcggcaccaaccctgaccaagctgtgtccagcagcagtttccttttggctgcacagacaaggtggcggcggggaaacactcgcaagcaggcactggtgcacatgcgggaattgctgacagctgccgtacgagtcgggggagtgacgcatcttgtgggtccagtgacgatggtccttcagggaggacccagaattgaagaactcacatgtggtgggatggtcgagcaggtccaggaagcctttggcgagaccatgacctctgttgtgtctctgtgtgctcgttaccctatcgcttgcgcaaatagcattggactcttatgtaccataccttacaccaggagcgaagagaagtgcctggtacgcagtggccttgtgcagctcatggatcgactgtgtagcttgagcaatcagaccgagtccagctccagtgagaaacagaccaagaagcagaaggtggccaccatggcctgggctgccttccaggtgcttgccaaccgctgtgttgagtgggaaaaagaggaaggtggctccacagaggctgtgcactcaggtctggcccggcaggtgtccagccttctcactaaccatcttgcccgagccacagagtgctgtggcaaccaggctgctgggaatgacgcgctccaggatgtccttagtcttctcaatgatctctcaaggagccacataggtaaagccatcctgagccagccagcttgtgtgtccaaactcctctccctgctgcttgaccaacgcccgtctccaaagctagtccttattattctccagctgtgccgggcggcgctgcccctgatgagcgtagaagactgtggaaacgtggagctcccaccctggagctactctgtcccctccttaaacagtgagcaggaggatcccagcgacccagcttccaagatcgcctccctgctcttagcaaagctggcagattatgtggttccaggatgtcagacagttctttctccaaccgcttctgaacctgacaccacattgacaaaaaccagtcccaagaattccttgaaaggagataaagatcctggagaagagagtgaggctgtggatggcaagctctcgatatttatccacaagcgggaagaccagtcatcccatgaagtcctccagccattgctaagtagttcagaaggacggcccttccgacttggtactggcgccaacatggagaaagttgtgaagatggatcgagacatgaccaagggtggctgttgcgaagtgattacagaagaggctgcagccgccctgcggaaagccaccaagtgggcacagtcaggcctcatcgtcagcattgggccacctgtagagtctatcaacccagagactgtgagtggactatccacaggcgacaaaaagaaaactgcccaaacttccatttgccgagagaggaactcggagcttgcaaggactgatcctgtgcgtcccttcatcagtgggcatgtggcaaacagcatggctgcagaagtgatcgccttgctacatagcttgctcatggcacctgaatcaaatgctgctcaaatatggaccacaacagcagagaaggttctgtctagagcactgatgtacattccacaattggggaaatacgcagaaagcattctggaaaatggcagcagcagtggcaggaaacttgccaaacttcagagaattgcacgccaggccgttgccgcactgtgtgcacttggaggcttcaaagagacaatcaagataggatccgaggttcaggttttaggtagaggaatttcaggaagcattggagtagtggcttctatcaatgaacaggaaggtatagctacagtcagattcccacccatagactgtagaaagacttcgcaagcgtcagacacattgactattccattgtctagactttgtgttccaagatcagaggcattgcctcttcataaactgtccattactgagaaggtagtacaggcagtccagtccatgttgcttcctcaggagggaagtctctctattcacacctcacttcctgcaacaggagatgggtcagctcctgtgatggcagtcgttcggctccttgctgaaataaggacaagagcatgcctggtcatggcccagcttttagaagacagcttattttgtgaagaattcatacaacaatgtccagcagctgttgaagttcttaacctagtagcccaggaatgtagtgctggagagcgacttgcagttgtggaggtacagtgtgaacggctgaggatgctctaccgggactgtgctcggcccccaccacctcctttgcaggctgaccgaagacagcccaaagagattacttggagcccctcgcgagtgtttccgcctgttcgagcctgcatgttctcatctcaccttacctcagtcaccttcctggctgaccccagcgctgggggaggcctgccccggggcacttttatctatgccacttcaccactgccagttcaggccccgtctttttactgggaaattgaaatcgtttcctatggagacaccgatgatgacaccggacccatagtttcctttggcttcactacagaagcagagaagcgagatggggcttggactaatccagtgggcacttgtcttttccataacaacggccgagccgtgcactataatggctccagtttgttacagtggaagagcgttcgcttagacgtgactctctcccccggtgacgtggcaggaattggctgggagagaactgaggggactccacctcctccgggacagccagccaagggccgggtgtacttcacatactgcgggcagcgcctctcaccatatcttgaagacgtctctggtggcatgtggccagtggttcacattcagaaaaagaacaccaaaacccgagctaactttggctcccggccgtttgcctacgcggaagggcaggcccaccgcaatgctgctgacctgtgcactgacctagcagaagagatcagcgctaactttgaggccctgcctttcgccatggcatctgacagtgacaatgatgctggcaccagtattgcatcagacccaggcactcatgggccaccatgccggattgctgccgtggccaccgctcagcaacaatatgatagtgacacctcctgtcattataaagtcgagctcagctatgagaatttcatcacctctggcccagaccctcacccgcctcccattgcagatgatgaaagcgatgatgatgacgatgatgacatccctcaggaggaccactacgccctgctggtgaaagcatgggagaccaaggtttttcctaccatccgaagacgcttccgcaatgaagcagagcggaaatcgggcctggaccagataaagggggccttacaactaggtatggtggatattgcccgacagacggttgaatttctctacgaagagaatggtggcatcccaagagacctttatcttcccaccattgaagacattaaagacgaagcaaacaagttcacaattgataaagttcgaaaaggtctcacagtagtaacccgctctccagacagcaataatgtagccagcagtgctgttggaactgctctgccaaaatttgccatccgagggatgctgaaaacctttgggcttcatggagtcgtcttagatgttgattcagtgaatgaactggtgcaggtagaaacgtacctccgcagtgaaggtgtgctggtgcgatactggtatcctattgacatgttggaaaggcccccagcaggctaccgaaggactgccaccaatgggctggtcacactggacaataccaaccttcaaattcacagggagctgctgcgctgcgaggctgcgctggccaggctgtactgccgcatggccctgctcaatatcttcgccccgaagttgcctcacttgttcactcgcctcttccacatccctgccatccgggacattaccctggagcacctgcaactgctgtccaatcagctcctcgcacctcctctcccagacggcaccatcagctccagctcgatcctcctggcgcagtctttacagcattgcatccattcccagaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattattatggtc

SEQ ID NO: 1154 - DNA, 15336 bp, Homo sapiens; identical to SEQ ID NO: 1153

SEQ ID NO: 1155 - DNA, 2323 bp, Homo sapiens
gagccgaggcgagcatctcccaccgccgccgccccgcgccccaggcgcccgccccccacccgctccagcgccctgccgcgggccaaacctccccaccatgccccgcaccccgcccgctcctgcgaccccccagccccgctcagtcccgagcgcccgcagtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagat

SEQ ID NO: 1156 - DNA, 2245 bp, Homo sapiens
gagccgaggcgagcatctcccaccgccgccgccccgcgccccaggcgcccgccccccacccgctccagcgccctgccgcgggccaaacctccccaccatgccccgcaccccgcccgctcctgcgaccccccagccccgctcagtcccgagcgcccgcagtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgctgcccctcccaccggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagat

SEQ ID NO: 1157 - DNA, 2695 bp, Homo sapiens
gagccgaggcgagcatctcccaccgccgccgccccgcgccccaggcgcccgccccccacccgctccagcgccctgccgcgggccaaacctccccaccatgccccgcaccccgcccgctcctgcgaccccccagccccgctcagtcccgagcgcccgcagtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagat

SEQ ID NO: 1158 - DNA, 2432 bp, Homo sapiens
ctccctggcgcagccgtccccgtccccgcggctgcctccatcccgcctcggctcggcgggcggctccgcgcagtctcctgcttcgggtccccagtccgctctcggcactccctgcctcggggtcccttcgccgacctccttttcctcgtctccccccactctcgccgctctccagccctgtgcggggagtgcgggcctgcgggatgggtgggatgggggccacgctggggctggggcccggctcccgcaccccgaggctcctgccccacccccagctcgtctcctgcgcacaacagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagat

SEQ ID NO: 1159 - DNA, 2731 bp, Homo sapiens
cacggagagagaagaaaggagattagcagggtgactttcaccctgcaacagtcacgctggagtactctggtgaaggatcaagaatattaccagttttctgatgaagaaaggaatatatttggtcaccagcaatctgcctttgaccatcctcaaagccaagtttttcatcgctgtctagaaaaatacttcattcagaggacacatatgtcctctttgaatgtctcctttttgggagcagtaggagaaagaaacttcaagatgtagaaagaattaatagtgtaacggaaagaaagaaggcaaaaggaagtaaatgtggaggccatagaaatagtaataagaataaagaagaaaaacaggaaagaagagggaaaagccatagaaaataacagccagagcgagtaggaggagacagagagaacgagagagagaaaagctgataaattcctgagaaaagtttctcttcttaagaattctaggtcaagaagtaaaatatggcacagagcattgaaaggaggcaacggatgcccagtgcaagattctgaagaagcaggaattcagcccgatgggagtccgagttcatgtcgtggcggcctcagccctgctgtatttcatcctgttgcctgaccacagactgggtacatctctggtatatatggttgctagtggtaattggcgcgctgcttctcctgtgtggcctgacgtccctgtgcttccgctgctgctgtctgagccgccagcaaaatggggaagatgggggcccaccaccctgtgaagtgaccgtcattgctttcgatcacgacagcactctccagagcactatcacatctctgcagtcggtgtttggccctgcagctcggaggatcctggctgtggctcactcccacagctccctgggccagctgccctcctctttggacaccctcccagggtatgaagaagctcttcacatgagtcgcttcacagtagccatgtgcgggcagaaagcacctgatctacccccagtacctgaagaaaagcagctgcctccaacagagaaggagtcgactcgaatagttgactcttggaactgatgagagctgtcattttataaataggagtggagtgatgtccagagtctgtgggaaaatggaacacatacttttctaaccctcagaagttttaagatggcatctaacaccatcattctatgggaaagatggttcttactcttcgttcacaggcctttatatcttccgatacagaatgctctaattgggaactctaattttgtatccaatggccaaaatctgcaagtaatctctagccacactgattactactaaaccaggaaagcatcaaggtgtcttgaattcctttaactattgagtgcatatagaattcctgtacccacatgatactgcaagttgtgtctctctctgtcagcgaatccactgcggttaactggaaaagaaagacaacagtgtcagcacagccatcgacattaatgcactgaatgcatgcatctttcctcctgagacagcaatcgattttacaccgaatgacaatgatcatcttagacagcacaacatacccactcggatatctaaaagctagggatggcattgctgatatgggcaaagagaacacagtatagtatttaagtgccaaatatcagtctttctttctctctggtcctacccctcagcagtatgaaaaactccatactgtgcagtcacagttggattaattcttcagttcctccgcactgcaaacacatatatgtgcgcacatgcatgtatacctgcaccctgttttaactctaaaggaatagtgttgctttacttctttcctgttttgcctggaccacttaaagccacaacacctctatagtgacacacgctagtctctagtggtggccctcactgccacctagaggagccatggtggaaaacacactctctcctttgagcctatctgcacatctctcgagttcttggagcaaaaactaaatgctgaactaagcctggttgagatgcttcccatggaccatgccgcagcacagtgctaatctatccacaaaacataccacctcccaaagtattattattggaaaatcgaggaagtgacgcacatttagggaaaaactactcaccttagaaaagtcactgaaatccttttttttttttttgagatggagttttgctcttgtagcccaggctgggatgcaatggcatggtctcagctcactgtaacctccacctcccggattcaagcaattcttctgcctcagcttcccgactagctgggattacagctgcctgccaccgtgcccagctaatttttgtatttttagtggagagggggtttcaccatgttggccagtctggtctagaactcctgacgtcaggtgatccgcccaccttggcctcccaaagtgctggaattagaggcctgaccccctgctcctggcctgaaatctttaaagccgttttttccctaaaaaatgggaaataataacacctcagaaggtttttgtgaagatcaaagaagctaaatatatgtggcatgatttgtaaagtgttatgcatatgtatgttattcttcctactgtcttctaaccttcccttgcctgctatgacttatctgagagccatgttcccatttatctttttgccaactatgttactgttgtcacacctgaaatggctttgtttttatcaataaatacttgttgattgcggtaaacagcaac

SEQ ID NO: 1160 - DNA, 2601 bp, Homo sapiens
agtgccatggcgccatctcaggtcactgcaacctccgcctcctgggttcgagtgattctcctgcctcagcctcctgagcagctgggattgcagccgcgcaccaccacagcaggttaaattttgtatttttagtacagatgaggtttcaccgtgctggtctcgaactcctgacctcatgatccgcccacctcagcctcccaaagtgctgggattacaggcgtgagccaccgcgcctggcctcatcactcttaaataatgaaaaactaaatttttagaggaaaaagaaaatcacaggaccctgtgaaggaagaattctaggtcaagaagtaaaatatggcacagagcattgaaaggaggcaacggatgcccagtgcaagattctgaagaagcaggaattcagcccgatgggagtccgagttcatgtcgtggcggcctcagccctgctgtatttcatcctgctttctgggacgagatgtgaggaaaactgtggtaatcctgaacattgcctgaccacagactgggtacatctctggtatatatggttgctagtggtaattggcgcgctgcttctcctgtgtggcctgacgtccctgtgcttccgctgctgctgtctgagccgccagcaaaatggggaagatgggggcccaccaccctgtgaagtgaccgtcattgctttcgatcacgacagcactctccagagcactatcacatctctgcagtcggtgtttggccctgcagctcggaggatcctggctgtggctcactcccacagctccctgggccagctgccctcctctttggacaccctcccagggtatgaagaagctcttcacatgagtcgcttcacagtagccatgtgcgggcagaaagcacctgatctacccccagtacctgaagaaaagcagctgcctccaacagagaaggagtcgactcgaatagttgactcttggaactgatgagagctgtcattttataaataggagtggagtgatgtccagagtctgtgggaaaatggaacacatacttttctaaccctcagaagttttaagatggcatctaacaccatcattctatgggaaagatggttcttactcttcgttcacaggcctttatatcttccgatacagaatgctctaattgggaactctaattttgtatccaatggccaaaatctgcaagtaatctctagccacactgattactactaaaccaggaaagcatcaaggtgtcttgaattcctttaactattgagtgcatatagaattcctgtacccacatgatactgcaagttgtgtctctctctgtcagcgaatccactgcggttaactggaaaagaaagacaacagtgtcagcacagccatcgacattaatgcactgaatgcatgcatctttcctcctgagacagcaatcgattttacaccgaatgacaatgatcatcttagacagcacaacatacccactcggatatctaaaagctagggatggcattgctgatatgggcaaagagaacacagtatagtatttaagtgccaaatatcagtctttctttctctctggtcctacccctcagcagtatgaaaaactccatactgtgcagtcacagttggattaattcttcagttcctccgcactgcaaacacatatatgtgcgcacatgcatgtatacctgcaccctgttttaactctaaaggaatagtgttgctttacttctttcctgttttgcctggaccacttaaagccacaacacctctatagtgacacacgctagtctctagtggtggccctcactgccacctagaggagccatggtggaaaacacactctctcctttgagcctatctgcacatctctcgagttcttggagcaaaaactaaatgctgaactaagcctggttgagatgcttcccatggaccatgccgcagcacagtgctaatctatccacaaaacataccacctcccaaagtattattattggaaaatcgaggaagtgacgcacatttagggaaaaactactcaccttagaaaagtcactgaaatccttttttttttttttgagatggagttttgctcttgtagcccaggctgggatgcaatggcatggtctcagctcactgtaacctccacctcccggattcaagcaattcttctgcctcagcttcccgactagctgggattacagctgcctgccaccgtgcccagctaatttttgtatttttagtggagagggggtttcaccatgttggccagtctggtctagaactcctgacgtcaggtgatccgcccaccttggcctcccaaagtgctggaattagaggcctgaccccctgctcctggcctgaaatctttaaagccgttttttccctaaaaaatgggaaataataacacctcagaaggtttttgtgaagatcaaagaagctaaatatatgtggcatgatttgtaaagtgttatgcatatgtatgttattcttcctactgtcttctaaccttcccttgcctgctatgacttatctgagagccatgttcccatttatctttttgccaactatgttactgttgtcacacctgaaatggctttgtttttatcaataaatacttgttgat

SEQ ID NO: 1161 - DNA, 1456 bp, Homo sapiens
gcattgaaaggaggcaacggatgcccagtgcaagattctgaagaagcaggaattcagcccgatgggagtccgagttcatgtcgtggcggcctcagccctgctgtatttcatcctgctttctgggacgagatgtgaggaaaactgtggtaatcctgaacattgcctgaccacagactgggtacatctctggtatatatggttgctagtggtaattggcgcgctgcttctcctgtgtggcctgacgtccctgtgcttccgctgctgctgtctgagccgccagcaaaatggggaagatgggggcccaccaccctgtgaagtgaccgtcattgctttcgatcacgacagcactctccagagcactatcacatctctgcagtcggtgtttggccctgcagctcggaggatcctggctgtggctcactcccacagctccctgggccagctgccctcctctttggacaccctcccagggtatgaagaagctcttcacatgagtcgcttcacagtagccatgtgcgggcagaaagcacctgatctacccccagtacctgaagaaaagcagctgcctccaacagagaaggagtcgactcgaatagttgactcttggaactgatgagagctgtcattttataaataggagtggagtgatgtccagagtctgtgggaaaatggaacacatacttttctaaccctcagaagttttaagatggcatctaacaccatcattctatgggaaagatggttcttactcttcgttcacaggcctttatatcttccgatacagaatgctctaattgggaactctaattttgtatccaatggccaaaatctgcaagtaatctctagccacactgattactactaaaccaggaaagcatcaaggtgtcttgaattcctttaactattgagtgcatatagaattcctgtacccacatgatactgcaagttgtgtctctctctgtcagcgaatccactgcggttaactggaaaagaaagacaacagtgtcagcacagccatcgacattaatgcactgaatgcatgcatctttcctcctgagacagcaatcgattttacaccgaatgacaatgatcatcttagacagcacaacatacccactcggatatctaaaagctagggatggcattgctgatatgggcaaagagaacacagtatagtatttaagtgccaaatatcagtctttctttctctctggtcctacccctcagcagtatgaaaaactccatactgtgcagtcacagttggattaattcttcagttcctccgcactgcaaacacatatatgtgcgcacatgcatgtatacctgcaccctgttttaactctaaaggaatagtgttgctttacttctttcctgttttgcctggaccacttaaagccacaacacctctatagtgacacacgctagtctctagtggtggccctcactgccacctaga

SEQ ID NO: 1162 - DNA, 542 bp, Homo sapiens
aagaaggcaaaaggaagtaaatgtggaggccatagaaatagtaataagaataaagaagaaaaacaggaaagaagagggaaaagccatagaaaataacagccagagcgagtaggaggagacagagagaacgagagagagaaaagctgataaattcctgagaaaagtttctcttcttaagaattctaggtcaagaagtaaaatatggcacagagcattgaaaggaggcaacggatgcccagtgcaagattctgaagaagcaggaattcagcccgatgggagtccgagttcatgtcgtggcggcctcagccctgctgtatttcatcctgctttctgggacgagatgtgaggaaaactgtggtaatcctgaacattgcctgaccacagactgggtacatctctggtatatatggttgctagtggtaattggcgcgctgcttctcctgtgtggcctgacgtccctgtgcttccgctgctgctgtctgagccgccagcaaaatggggaagatgggggcccaccaccctgtgaagtgaccgtcattgct

SEQ ID NO: 1163 - DNA, 708 bp, Homo sapiens
ggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccagtgcctctccatgagaccataagctcctgtatgacagaagccatgttctttttagcggcctccgtagcatgatgggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 1164 - DNA, 677 bp, Homo sapiens
gtggcctcgagaccctgcctgcctgaggaggcctcggttggatgcgaaggagctgcagcatccaggtacgctgccggctagggccgagcaggggctgccagtcccactgcctgcgcgcccacctgggccagtctccgcttgccgcgtcctcccatcccctagtctgcaggcctggtgcccttgaattcacccgcttctgttgcgttgcggaccgcgagctgcactgcttcctgcccaagcccaagctcctcgcagcagtaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 1165 - DNA, 739 bp, Homo sapiens
ggaagttcaaagccggcctccagccagagtgacggcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 1166 - DNA, 580 bp, Homo sapiens
tgcgttcggctgtgctgggaagttgcgtagacagtggcctcgagaccctgcctgcctgaggaggcctcggttggatgcgaaggagctgcagcatccaggcgcggtggctcacgccgtaatcccagcactttgggaggccaaggcgagtggatcacaaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtgtctgtg

SEQ ID NO: 1167 - DNA, 2104 bp, Homo sapiens
actttaacaatactcctaaacaactgctaggaccacggaactcagaaacacagcaagcgatcatattggaaatatggcccaaagtgacttcctttacccagagaacccaaaaaggcgggaagaagtaaatcgtcttcaccagcagcttcttgattgcttatctgacagcttcgatgtcaccaataagctgactgaggttctaaatatgcacttggggtgcaggctggcctccattgagatgaaaagagatgggaccatcaaagaaaactgtgacctcatcatccaagccattatgaaaatccaaaaggaattgcagaaggttgatgaagcactaaaagataagctagagccaaccctctatagaaaacttcaggatattaaggaaaaggaaacagacaaaattgcaatagtgcaaaaggttatttcggtcatcctgggagaagctacatctgcagccagtgcagtcgctgttaaacttgtgggctcaaatgtcacaactggcataattaacaagttggtcactgtgttagctcaaattggtgcttctctccttggtagtattggagttgctgttcttggccttggcatagatatgattgtccgtgccatcctgggagcagtggaaaaaacacagcttcaagcagccatcaaaagttatgagaagcatctggtggagttcaaatcagcctcagaaaaatataatcatgccattactgaggtcatcaatacagtgaaacaccaaatgaaatgaacagccgttttatttgccactgaagtgtttttctgcttccttttcagtaacagtgtttgcttctttgattaggttcattttctataggcttccaatatggacttaaataagataaacaatttggagagggaaactggagatgccaagactagatgactagatgagttttgagtcaacaatgcctggatcagctgatgctagaccctgtgaggtaaaaaaattttctccctggatgttttcacaccctgctctaccagatcaacattggggtaaatgctatcgtagagtagcaagtataggggttacttttctcttttctaatttcagtaaaattcttaaatttcacattgaatgcagagactttcatttctaccaccagcttcaaacatcatttagttataaggggacatactcagtaacttctgcctagacacaaactctaggccttcgaatgagacagaaatactaccatatttttgaccatcagagtaaatctggttttctgtaaactagaagagactgaaaaatggtttgtaacaatgtgcttcaattaggacaggaagctgatctgtaaacgtctactgattacacaatgtaaaccggatggatttgaaaatggtaaaaatcaaaactaaaaacatcaaggtcctgtttcagtcactgcaatcaaccctgaccaactgtgataattaaatatcgctcaagtgaatgttcaaacactgaaacatttagaagacaagaaagcaaaacacagctacacatattgcatttaggatgcagaatagaaggtcactactcaaagcatttgtcatttaaaagaaagtcataatttattataagctttcagaaaaaagaatataatttcattttcaacactagcaaaaaggaggcagctgcctttgctacatgacgcattaggtgggccatttcactaattacctgattttagaaaacgccaaaggctatggaagcctattaatggttccgctgaatctctgcagatgtgtttgttttctaaatcctttgccaaccaataattcccatgaggactcttttagtctatactgacaaaattattaatatgctgttgatgccagactgtgtttgttatagttgattctcccatccaagtacaagaaatgtattgaaataaaaactgctcagcatatcttaaaaatagtagctacatataaaattttagctacatgaaagactttaatatttccaacatacactgttttctctttctcttcttgcattgtttttcaaaacgagttgcaaaactatgatcactaatgtgttaggaaagaaaaaaaactagttgcaaaacattacaacttagctcaccttcgc

SEQ ID NO: 1168 - DNA, 709 bp, Homo sapiens
ccagtttgttgttttacctaaaaggtgttttccacgtggagtgggactgagaggcacaggtggctgaggggacccgcctgggatgtgaggcgcaggtgtgctcggccccttcatctgtcagctgcagcaatggaatacgtgctggaagtgaagaactctccgcggcacctcctgaagcaattcacagtgtgtgacgttcctctgtatgacatttgtgactacaacgtctccagggaccgatgccaggagctcgggtgctgcttctacgaaggcgtctgctacaagaaagcggttcccatttacatccacgtgttctctgccttgattgtgatcatcgctggggccttcgtcatcaccatcatctacagagtcattcaggagagcaggaaagaaaaggccatccctgtggatgtcgcgctgccacagaagtccagcgaaaaggcggagttggcctcatccagcagcaagttagggctgaagcctgcgagtcctgggcctccaagtgctgggccctcgatgaagagtgacgaggataaggatgatgtaacagggacaataacagaagccgaagaaactgaggactgactgagacgcatgaagaagtggagattgtcagaattatccaaatgaaatggtacagcaggtgcactgttaacagtgtgatggaatgaccacccaaagagaaaaaaataaaggtattttgaaaatt

SEQ ID NO: 1169 - DNA, 822 bp, Homo sapiens
gtgttcatgggcctcattaagctctgccttccttctgctttttggagcctggcctttggttggccttgaatgaagagtggggccccaaaagtaccactgtcagcactctccagcatcatctggctgtctggcaccatcaaagaattgcatttctgacccaagaagagcttatgggtggatgggggtgggatggaagctggggagaggattgatgccagccagctgcctcacagggtgctggaaacacgtggccatgccattagcatcctgttcggcttctggacgagtttcatctgtgacacctacatagtcctcgcttggatcagcaagataaaaggcagccctgatgttagtgcctcctctgatgagccatacgccagaatccagcagagcagaaggcaatgccacgcagaagaggaccaaagtcaggtgccagaagcaggctgacctggaaaggtggaggaaaagaaggcagaagggagagatgaagcccaagaacctgagtatttttctcaggcaagactcaggactgctctggacattcagaagctgagtgtgcaagtgtgctgtgtagttcaaggccaccaccactgaagaggccaaggacaccttagtaggaattctaacctggcttccagggagaggtgcttccaaattggccctgtaggcaaattcacttttttcaccctctaagcgagtaagtgcttgttcccaatttccatggtttagtcttcagtttcagtctttggtctcctctggtctatcagctcccatctctctcccagtctttttctttattctgtgacacctgttgaatgaggc

SEQ ID NO: 1170 - DNA, 4264 bp, Homo sapiens
ggctcgacccggaagccgccgtggccgccgcacaagctgcgctcgtctctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgttctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagtgtttgtgaccaaaggaccaactatgtgattgataagttcgcaaagaaccttctcacctctatgcctcatgatgcaattatcttactcagaggagatttgccaggaaattctctccgttacatgcattactgtgaggggttgaggcctgacatttcattagtggatcaggaaatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaagttaatttgatgtttgcttatttcagttgcagaaactggcgagtaaaaaagattttgcatttacttaattaattttatatttatgttttatttctatttggactcagagatctagacccaataattagtaggctcctgctgccaaaatgcaaaggggaaaaaaaggcagggattgggggggatggggaagtggcccaataaattcatttctgttacaagcatcttttatacatattactaaagagaacatagtaagaaatgcaaataatagttctttattttattatgacagttaattaatagcaacctgttttaatgaataaagtcactcagagtccttcagcacttcctaagtagaggccagaatctgtagggcttcttttccccccaattgtatagctcctagactccaagcactatataggcccctgtatagaaatgctcactaatgaagagggagggctagaagcttgtctgcattcaaagatcactggtgagtcattcagcaagaaaaggccccttaccaggaatagtcacagttccgtggcattgtactagcaaaagggtctgatcaaaggtctcctgtggagcttgcatggttccctttcatactacgaccataattaaaaccactaattctcttttaaaatgctgcaggatgccatgtaggcatctgtctggagtgtcctttgtgatgtcataagctgttaaggaccagtgccgagggcttttgagtgaaatgccagtcatgaaggtgcttcaagacaagggtgcctctaaaagcttgacagggccttgactgcacaattcgagctgaatttgccccttgtcagctgccagtaaataaatctcaaagggggaaaagctgaagtttcattacctgatccatggggctttgttggttttggcatcacacaggggaagctcttgcccctccattctctggatttgaagatgtccattggagcctgcagtgcctggacagggttcagagcggaaccttttgaagagtgtcaatagttgtaacagttcagctgttaggaagacaaataaatggaggagctcattaatccgcttttggctctcagtgccttttgcccttttatcacagccttattaggctcctactcatcttgaaccagaaaaaaatgaattgaagttgttgagtactaattggcaaagacttttaatcatgggccaagaactttcactgacttgaaagtaacttctccacagggaaggaccaaaaacctggtttaccttaaaacaaaaacctgttggagttcagcgtggtgtaaaaatgtaaggaagcattgataaattgtctaagtttatccatttgaaagaaattgtgtaagattatgatattctcttttctttaaaaaaaaaagtacaataaaattcaaacattccttaggaaa

SEQ ID NO: 1171 - DNA, 2218 bp, Homo sapiens
aagctgcgctcgtctctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgttctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgctt

SEQ ID NO: 1172 - DNA, 1638 bp, Homo sapiens
cgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgttctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgagg

SEQ ID NO: 1173 - DNA, 909 bp, Homo sapiens
gcgcgcttccggcccgagccggaagctccgactgcggcggcatccgggacggcgggcgggctggccaccacgggacaggaaggcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctggtaccttacttacagatgtttttgttcctatactcttgtacaagagctgatcccaaaacagtgggctactgtatcatccctatatgcttggcagttatttgcaatcgccaccaggcatttgtcaaggcttctaatcagatcagcagactacaactgattgacacgtaaaatcagtcaccgttttttccctacgattacaaaactgccagtcctatatggagtctgatcacaagactgcagtttcttcacagatctcaggaagttgtcgtggggcagaggctttttaaaaacatgtgattagggagctatctttatctgaataataacgaatttttaggtaaaacctgagatagagtactacaaaatcatgttgatgacttcagattttggaagttaaatcatgtctgttatttgcattctttagaaacttgactaagtacctgaattcatatttctattctactgtgcaacatagtgatgattcagaaatttttcctttggggaaaaaaatgaatatgaacatttccattgtgttaagtgtaaaaaggtccagacatgatcataaaatttaaattttatacaa

SEQ ID NO: 1174 - DNA, 1303 bp, Homo sapiens
ggccaccacgggacaggaaggtgagatccgggacctcagctttgcaagcaggctccgccggcgaccgctgacgggcgctgggctcgcggcgctgcaaggcggcgaggcccgggcctggcgccgcctgcgcagccttggtcgcggcgtgccggcgctgcagcgcggcagggggcggggccggccgcccggaggcccaagtggcggggacgcctccctgccgggtcaggttctcagagcgggtctccggcggcggcgacgggggccgggccgcgcgtgacccgccgcagtcacgccgttcttaatcactagtagctggtgctccaggctggcggcgctcacctttctcctagccgggtgacccaggggatttattttatgttggctttctctgaaatgccaaagccacccgattattcagagctgagtgactctttaacgcttgccgtgggaacaggaagattttcgggaccattgcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctggtaccttacttacagatgtttttgttcctatactcttgtacaagagctgatcccaaaacagtgggctactgtatcatccctatatgcttggcagttatttgcaatcgccaccaggcatttgtcaaggcttctaatcagatcagcagactacaactgattgacacgtaaaatcagtcaccgttttttccctacgattacaaaactgccagtcctatatggagtctgatcacaagactgcagtttcttcacagatctcaggaagttgtcgtggggcagaggctttttaaaaacatgtgattagggagctatctttatctgaataataacgaatttttaggtaaaacctgagatagagtactacaaaatcatgttgatgacttcagattttggaagttaaatcatgtctgttatttgcattctttagaaacttgactaagtacctgaattcatatttctattctactgtgcaacatagtgatgattcagaaatttttcctttggggaaaaaaatgaatatgaacatttccattgtgttaagtgtaaaaaggtccagacatgatcataaaatttaaattttatacaatta

SEQ ID NO: 1175 - DNA, 808 bp, Homo sapiens
gcatgtgcctgtaatcccagctactcaggaggctgacacaggagaattgcttgaaccaggaggcggaggctgcagtgagctgagattgtgccactgcactccagcctgggcaacagaacgagactctgtctcaaaaaaaaaaaaaaagaaaagaaaaaaaaaaagagcaacttactgctttgtgaggttgtgagtggccaccactgaaggtctttgagaagaggccagacgccgctgtagccaggcctgtcttaagaggacttgtgcttccagggacccaggcaggatgatggcgcagctcttcctactccaagccaatgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggctggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaa

SEQ ID NO: 1176 - DNA, 7774 bp, Homo sapiens
cgcgctcggggccctccgcctagtagagatctggagccagaagcccagagacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatggggtgaggcttggcacgtagctctgacttgctgtcggcctttggcttctcctgtgttctagaaccaggagttttgaccaggggcggcggccgtccttctggaatttctccccagcagccctgatttcaaatatcccatgttgtggtcaagctgagtcagaagacatggaagtatgggcctcctgcccctagaggcatgacggggcaaggccttcagagggcagattggggatccttgaaactacattccaggaacatgggaccagatgagacagctagttaagtttaaaacatagacatgatttgatgatcgcttgctggtggtaaataatcactcgtgtgtcttgtttttatgcaaacttatcgaacctagggcgtggggtgctggggcaagagcagccctcagaacttcagtgttcctgacccaattctggtttcacattcagtcccttggccatctagtagggccattggatgttcctagtttgactttgaaatggcacctttgccaccagacacctggtcccttccaagacccaagtgcattgggagacccagggatggggggttactggtaataggtggggtttctgggggtgttgttggtggtttttatctcctggtcggactttctcttctttttaagaagaggagaggatgtctttaagagctagatgtgccaggcagtggactcttcaggccacccacgtgagaatgctgtttcttctctgaggaatcgtggaattttaaagatgaacaagattcacatccactgaattattcaacggatgggtcagaaaggggggtgatttgcctgtggtcaccaggcaggtttgtggaggagtcggaacagaaagatgtgtcctcactctcagctcactgagctctctgccccaactaagcacttccctgaggaggttgctgagaagctgccctcaggagaatgtccaggcatcttgaaggtgggtgcgagattggcaggctgctcagatacccgtcctttacattcagtgtggataccgtgcattctcctgaagctgtgaaagtgcttctgcccaagccacttccttaaattctgaaatatcagcatctggggtcctggcaagcaaggaagcttccaagtaaaaaccagagagaagggcacacttttctttcttcattaggaaatcttattgcacaggaaccacccccacccccaccccccacaccttcccaaggcagcatcccagtgcagatagagtgggaaaggtcccagaagggggctcactcacctctaggcccagagaggctttctcctcactttatacactgcaaaaacagaagaattgtgtcaataacaccctctgtagtggagaaacttaaaaagctggttaggaagctctcgtgtatatttagagacaattacaagaaagctggacttgccgctgtggtctcaggagaaatgagtgttcttgatgacaggcaaagggacatcttagttgtccagaagcggcactcttccctggaagccgccatgttaataggattactagcctggctccagacagtgcctgctcatggctgccagttcttaccgatcacatctgtcactgccaccgtatatcatctgccagtgcatcagcttaaggggaggtcacgagtgcaaaagaacctgacccttgacaatgagggagaagggacatggaccacctgtctggaattcctggaatcactggcagggtggaggctgggctggggagttagccgcggtgtgcgtgaatggctctgtctccagcaagtctctctccatcaaaccccaggtctgccccataagcaagatctttaacagatggatgtctccatgagaaaacccaaggcgagaagcccagagccatggcggggttgcttgacgtcctcatggagtcactctgccccacatgctcaaatcttccctctggccccacatccctaggagggcctgacccctgtaaagatacaggaggcagctccctggcctccaaatggcccatggagatggcagtcgggagacagggttctgtgtttgctgcggtgaagggaggagaaggcaggaggaaaaaggatggcttctagccctgaagaggactccagcatcccaggcaccgggtgcttctggctgcagttttccctatggaggcccctcagcctccagccctaacataaatgtcggttaaattcagttttcaagcctctctcccttttcagtgtcagagcagtagatggtccagggcattggaggcctcgaccactctgcattgcagattacagtgacttcctcggggttgccccatcttggtctcctgtggtttcttcatcagctttttttttaccagcatctctcaaataacaatgaagatagatatgcccattagtgtctgattaaggagcaaaggctggatttctggccacagcgagctgcactctccctcctgcctcagccggggtccgtcttagcagtttggaaaggggaaaaagatgccggtcctcactgcttaagttttgtgtccaggtgccactagacttgcatgcacactaactccttacaatcaccacacagcatcatcgccccagtgcacagatgaggaaccagaggctcagaggagtgaagttgccttcctgaggtcacacagcatgaaagtgatgagctaggatttgaatctgggaagttgggctctagagccagactgtactgccttctgccacactgtactgccttctgtgactgggtggcacctccagggcacatttacacaaggccctgaatctgcagaggctgtttctcaagatgcccgtcatggtgtggcctgggccagctctggcttccacaggtccctgactgtcctcagagtggaacatgctcaacctcccgcccactgctctctctctgcccagatttcaggggtgccggtccccaaggcctgcccccttctttaagactgaactcaagtctccttggaaggccccggtgaagctcccagagactggttttcttgggatgcaggcagaaggggaccctccctggccaacacccaggagcccagcagaagcacccacacgtagaaagaggctcactacagccagaagtgcagagtcagagtcctgggaccatcttgttctgcaaggtgaccccaggctccccaggacaggggagagggatcgtcctcattcagactctagctggggcctctgtactggcttctccctgggtggggttgcctgttacatagctgtgcctcagagaaagggtcctgcattttctggaatgttctctgtgcttacccctctgtgtgcccctccattgctcctctacaagcaattaggtgattcaaaagagcaacttaggctgggtgcagtgactcacacccgtaatcccggcactttgggaggccgaggcgggcagggacaggagttcaagaccagcctggccaacatggtgaaaccctgtctctacaaaaaatacaaaaattaaccagacattgtggcatgtgcctgtaatcccagctactcaggaggctgacacaggagaattgcttgaaccaggaggcggaggctgcagtgagctgagattgtgccactgcactccagcctgggcaacagaacgagactctgtctcaaaaaaaaaaaaaaagaaaagaaaaaaaaaaagagcaacttactgctttgtgaggttgtgagtggccaccactgaaggtctttgagaagaggccagacgccgctgtagccaggcctgtcttaagaggacttgtgcttccagggacccaggcaggatgatggcgcagctcttcctactccaagccaatgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggctggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaattactgtcgcatttttctgtggagaaaactgaggccagggctgaacgctcacagctaaggagctgtgattcagacccagttctgtcagctctagaggcaccctgcatcatgcccaccagggtgatccccctgggatggaccatctcgggatatgaggcctcggaggctggggttgagatttggtcctgaagagcttatagccagattgccacattcaagtgtaagtccaggaaaggggcaggcggcagtgcacagggatttatcagttccagaacctcacagtgataagaggctttagagagcatctaatcgagacctttaatttttcggggagagcagctgaggccgtgtggaaaattagtggagagctgacaagtgtctgggctcctggcccaggggtccgtggtccagcacgttgtgcgttcagtgggaagcaaagggcttgcccgggattacctgccccagccccgaggtgggttgtgctccctgcagctgccatcggcccgctttgcttcgtcctggcagatgcccagtgattgtccccgagcaagtgccagggttgggctgagctgctatgacagggaggcccagggagttctgctcagggagccaaagggaacagccagatcctgaatgttctatgttcacctgccccagccccacccaccctggcccactccacaggcccctgaccatggtcactcacggagagggatggaggagaaggtggttgaactgagtactgagaacccagaggacagagcccacagcttccaagcaggaaaagggacctctctgaaaaatctggataaccagaattatcacagcaccttctcattcccagcgcgtccttctgagctcagaccttgagcatttactgggtttctttttgaggaagagggaaagtgacaaaggacaaaacaatgcaaatcttcatgactgaagacgatcaaagactccctggagcgagaaaacagttactgccagaagcagaatggaagagccaaaaagtacacaaaatggacgccataaattctgaaataaaagtgtatgatgtgttctgagtcactgtagaagtcatgcatttattatcaagatagaaaagagcagagaatgacgtggacattggtcctcggagaggctgcgtaggtggtgcggtccccgggggattctggatgctggtcttttgaccgtggcggcagcctcgcgcctgcccggatggctccatccagacatttggcaaggctgtcatctgctcttgggtcctttttcaagctgatttcctgcctccccaagaggaggtttgagccccattctgccttggaaataaatcctgacagatgtgcacagcatatttgcagggaatttgcaggcctcgattattgggggaatcagagcccattccacaccgagccccatccacgtggctgagcaacacccctgtgtcccctgtatctgtctcactggctgtctttctcccagtttcttaaagaaccacaccattactgcgtttgccgttcgaagcgttgtcccaacaatgcagatggttctgacaagggctctatatgctggcagaagggagcttccaaccttttaacttgaggaaaatgaatctctgagaggcttgagagtgttgccaggtggagcttttcaggagacaggggtcttgagcccaggacacctaactatcgagttttcactaggagacttagtggtggctttcatgaggccagtcgttctcaaggaagggctgggggccatcagcaatgtctggagacatttttgattctcacagcttggtggggactgctattggtatctcatgggtggaggccagggatgccaccgaacatcctacaatgcacagggcagccccccacaaataagaattatccagccccaaaatgccaatagtgccgaggtcaggggaccctgtgctggccatcctatctctgattctgaaactatgcatgctttccacttttccccatttgtgagtcattgagtaaattaaagctcttctgagcagcagcagtgatcatggtcactgccctgcgttcaaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgggcatgggagtgctgggtagcagcctttgagcaaatctgcatcttctcttatttctgacctttttccacgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgtaaaaatgtatctgtgaaatctcactttgttagcgttgctgctgttgtcattttctattatgataactgaaaagagaaaagaagaaaacatgaactcctctgtgtctggttctcatctgtgctttatgcaaaggagatgatctactcagctttaaatggctcagccccagcgtcacctccattctgatgcttttcctgccccaccgaggcaggacaggtcccctcctccctatcccctcctgataccactctatcatcacacctgtagcaaatcaaatcacggaa

SEQ ID NO: 1177 - DNA, 3932 bp, Homo sapiens
aacgacgctcttgcgtaaaggcccggcccaagggaacgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggagcgcccagcccgagtttacctgcaaaaatgcggtccctgggatgccttcgcgtcttctcttccctcgggtgacttgaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaata

SEQ ID NO: 1178 - DNA, 4107 bp, Homo sapiens
atgagtccagatgtgcctctactgaatgattacaagcaggacttctttctgaagcgctttccacagactgttcttggaggccctcgattcaaattaggctattgtgcccctccttacatatatgttaatcaaattattctttttctaatgccatgggtttggggtggagtcggaacacttttataccagttaggcatcctgaaagactattatacagcagcactttcaggtggattaatgctttttactgcatttgtcatccagttcacaagtttatacgccaaaaacaaatcaacaacagtagaaagaatactaaccacggatatcttagcagaggaggatgagcatgaatttaccagttgtactggtgctgagactgtcaaatttctcattcctggcaagaaatatgtagccaatacagtttttcattctattcttgctggattagcgtgtggtcttggaacatggtatctgctcccaaatagaataaccttgctgtatggcagtacaggaggcactgctctactattcttctttggatggatgacactatgtatagcagaatattctttaattgtaaacacagctacagagactgcgactttccaaacacaggatacttatgaaattattcctcttatgagacctctttatatttttttctttgtttctgtggatctggcacacaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttc

SEQ ID NO: 1179 - DNA, 4666 bp, Homo sapiens
tcttgcgtaaaggcccggcccaagggaacgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggagcgcccagcccgagtttacctgcaaaaatgcggtccctgggatgccttcgcgtcttctcttccctcgggtgacttgagaaactgctgtgttacagaaaagcatgtgactttcagaataatcccgagtgaggatgagtccagatgtgcctctactgaatgattacaagcaggacttctttctgaagcgctttccacagactgttcttggaggccctcgattcaaattaggctattgtgcccctccttacatatatgttaatcaaattattctttttctaatgccatgggtttggggtggagtcggaacacttttataccagttaggcatcctgaaagactattatacagcagcactttcaggtggattaatgctttttactgcatttgtcatccagttcacaagtttatacgccaaaaacaaatcaacaacagtagaaagaatactaaccacggatatcttagcagaggaggatgagcatgaatttaccagttgtactggtgctgagactgtcaaatttctcattcctggcaagaaatatgtagccaatacagtttttcattctattcttgctggattagcgtgtggtcttggaacatggtatctgctcccaaatagaataaccttgctgtatggcagtacaggaggcactgctctactattcttctttggatggatgacactatgtatagcagaatattctttaattgtaaacacagctacagagactgcgactttccaaacacaggatacttatgaaattattcctcttatgagacctctttatatttttttctttgtttctgtggatctggcacacaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaata

SEQ ID NO: 1180 - DNA, 2545 bp, Homo sapiens
ttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgtatttatgactatgcatcgctgaggcaacagatcagaaaaggcagacaaagagaagtgactaagattttgcctaatggtgattgagatggctgccaggaaacttttatttaaagaaccaaggaagtagagggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttc

SEQ ID NO: 1181 - DNA, 2545 bp, Homo sapiens; identical to SEQ ID NO: 1180

SEQ ID NO: 1182 - DNA, 2694 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaattgt

SEQ ID NO: 1183 - DNA, 832 bp, Homo sapiens
aagaactggggcgggctagctgccgaggagaccacgctgctgcatgggccacgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccagcctcagggaccttcacagtgcctggcacagaacctcactcatgactgttgctcaggaacgagctgccctccccactgttctgactccttcccctatcacctggcgcctgtcctggctgagatctttgagatcatggagaaagtccagccctggagaaatcccactggctctgccatctgtccactccatcgcccaagccagaaacccgcctgtacaggattaa

SEQ ID NO: 1184 - DNA, 2826 bp, Homo sapiens
caggtggcattcttcttcagagcagggcaagtgtaattctggaccaatgtgtgattctgagaccagaccaaccaactgaagttacagattacgaaaatgatagaaccagaaggtgctaacaaaatgtctgtcctgcatgtgtggcatttgacatgaagaaactgaggcccttgctgggcgcagtggctcatgcctgtaaccccagcactttgggaggccaaggcaggaggatcacttgagctcaagagttcaagaccagccttggacaagatagtgaaaccttgtctctaccaaaaaaatacagaagttagccaggcatggtgcagtgtacctgtagtagcagctactgaggaagctgaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagtttt

SEQ ID NO: 1185 - DNA, 2538 bp, Homo sapiens
attctccactgaggcccagctgttcctctccttgaaaagtcaaggcttggttcaagccagatagcacctgaggacagaacatatcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagtttt

SEQ ID NO: 1186 - DNA, 583 bp, Homo sapiens
actgaggcccagctgttcctctccttgaaaagtcaaggcttggttcaagccagatagcacctgaggacagaacatatcagaagacacaggaagggctctgaatggactcgcttgggacctctgctcaccccctgtattaaataaccaccgaggccagatgagtggaaataccctggttagttggcctgagtcacatggcactattgatgggacagatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccct

SEQ ID NO: 1187 - DNA, 1597 bp, Homo sapiens
tggcagggcaaaaccagtgagcaaggcagaaaattcctgaaattctccactgaggcccagctgttcctctccttgaaaagtcaaggcttggttcaagccagatagcacctgaggacagaacatatcagatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctag

SEQ ID NO: 1188 - DNA, 956 bp, Homo sapiens
gatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagtaagtcagaagggaacagagcacagcacagtccctccctccgccccaggcagtatccaccttgccccgccccacctaaggagcccaagggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccagcctcagggaccttcacagtgcctggcacagaacctcactcatgactgttgctcaggaacgagctgccctccccactgttctgactccttcccctatcacctggcgcctgtcctggctgagatctttgagatcatggagaaagtccagccctggagaaatcccactggctctgccatctgtccactccatcgcccaagccagaaacccgcctgtacaggattaagaagaaaataaaaaacacttgcattaccaa

SEQ ID NO: 1189 - DNA, 3075 bp, Homo sapiens
aagggtattctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcagatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaagttacagattacgaaaatgatagaaccagaaggtgctaacaaaatgtctgtcctgcatgtgtggcatttgacatgaagaaactgaggcccttgctgggcgcagtggctcatgcctgtaaccccagcactttgggaggccaaggcaggaggatcacttgagctcaagagttcaagaccagccttggacaagatagtgaaaccttgtctctaccaaaaaaatacagaagttagccaggcatggtgcagtgtacctgtagtagcagctactgaggaagctgaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagtttt

SEQ ID NO: 1190 - DNA, 484 bp, Homo sapiens
gagaggagctcagagaagcgagagcaaagggaagggtttgtgacgcagatgagagcaggaagagaaaaaggctctggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcag

SEQ ID NO: 1191 - DNA, 1060 bp, Homo sapiens
gggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacc

SEQ ID NO: 1192 - DNA, 2687 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagtttt

SEQ ID NO: 1193 - DNA, 544 bp, Homo sapiens
cttctcgagccagctctctctgtggggtgacaaatgaccactggcagcctatgctcacattgtccctgtgtctagcagtttcagaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagctt

SEQ ID NO: 1194 - DNA, 2716 bp, Homo sapiens
cggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagtaagtcagaagggaacagagcacagcacagtccctccctccgccccaggcagtatccaccttgccccgccccacctaaggagcccaagggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 1195 - DNA, 622 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagtaagtcagaagggaacagagcacagcacagtccctccctccgccccaggcagtatccaccttgccccgccccacctaaggagcccaagggtattctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaac

SEQ ID NO: 1196 - DNA, 909 bp, Homo sapiens
agtccgcagctcgtgcttgacagtgaggagctgctctcctccgtcgccgccgtccgcgctggtccccgcggcgccgccgctgctgccaccctcctcctccatcttctcctttttttccgatcccgcgggtcgctacgaggggaacccaggagacagcggacgcccgtcccctcgcagccgctgccgcggccccaggagtcggggtgcggcggctccagaactcggacgcaaagacgagtctctttcccgctctggccgcacggctcgctcctcgcctcctcccccttcggcgggcaccgctagtaccgcgcaaccaaaccgccccctgctccaccgccgcctcctcaggccgctccgcccacagccagcaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaag

SEQ ID NO: 1197 - DNA, 853 bp, Homo sapiens
gagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccag

SEQ ID NO: 1198 - DNA, 2856 bp, Homo sapiens
cgaggtggcaattggggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccagatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 1199 - DNA, 558 bp, Homo sapiens
gttgcttggcggggaggcaggagagggaggagcgccgccactccgattgatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccag

SEQ ID NO: 1200 - DNA, 2976 bp, Homo sapiens
gggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccaggtgactttgcgggggtctcttctctaggattatctgtacttcccctctgtcctcttttactacgggagatcgagctagctataacccaccttctttcatgagaaccacactaaattgcaaaaattatcccagtgctggaggagggcagcaggttgagattatgttggcaggaagaatgttggcattgattggcacgcaggggacgagagctgctttgtgctttaaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 1201 - DNA, 2764 bp, Homo sapiens
ccccaggacaatggcagggcaaaaccagtgagcaaggcagaaaattcctgaaattctccactgaggcccagctgttcctctccttgaaaagtcaaggcttggttcaagccagatagcacctgaggacagaacatatcagatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 1202 - DNA, 650 bp, Homo sapiens
agcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaaggtctcactctgttgcccaggctggagtgcagtggcgtgatcttgattcaccgcagccttgacctcctgggatcaagtggtccttccacctcaacctcccaagtagctaggactacagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcaga

SEQ ID NO: 1203 - DNA, 862 bp, Homo sapiens
aggtgacaaagctaatcgaggtggcaattggggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaag

SEQ ID NO: 1204 - DNA, 550 bp, Homo sapiens
gtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttg

SEQ ID NO: 1205 - DNA, 2327 bp, Homo sapiens
gaaattctccactgaggcccagctgttcctctccttgaaaagtcaaggcttggttcaagccagatagcacctgaggacagaacatatcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccagtactcggagcagctgaaggacatggtggccttcttcctgggctgcagcttctccctggaggaggccttggagaaagcgggtgcatacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagtttt

SEQ ID NO: 1206 - DNA, 2009 bp, Homo sapiens
gttccagtggtgagcgttgggctgggagccaaggcttttcccaggagcccagccaccccgcctggctgtgttctgcctccgccctgcagaggaaaggccagcgaggcagtgtccatggtcccagtcttcttccaccggaagaaggcacaacctgcatctgcagccccagggccattgggttaggcctgtggccaaactactaaggtgctgggagactgaggaggcccagctcctcctggggccaccaagcccgtggttgacggcctccccatggaccgggctgtcccgagagcagcaagtcagccggggccctcagggccgctgaggccactgctcagtgtcgccgtaatggaaacttctcagctggttgtgagccgcaacagctctggttcacaccctgcgacagcgaggctgtgaccgccagtggatctcggggctgatcaggcctgagccaccccggaggtacagcaccagcaggagcccaggaccatgttccagtaaatgaggactgcagcaggagccgtgagccctgactcccggccagagacacgacgtcagaccagaaagaatgaggaggccgcgtggggcccgcgggtgtgcagggcagagagggaggacaacaggaagtgccccccctccatcctgaaacggagccggccggagcaccaccgcccagaggccaagccccagaggacctcgaggcgcgtgtggttccgagaacccccagcggtgaccgtccactacattgctgacaagaacgccacagccactgtcagggtgcccggccggcccaggccacacggcggctccctgctcctgcagctgtgtgtgtgcgtcctgctcgtgctggccctgggcctatactgcggccgggccaagcccgtggcaacggcactggaggacctgcgggcccggctcctcggccttgtcctgcacctgcggcacgtggccctcacctgctggcgcggcctcctgcggctctgacgggcaggacgggcaggacgggcagggcttccaggagagctcaagcactccgggggctccgagacagcctgagccctggccctgctgcttggtgaatcatgggggccaaaaggggctgctgcctgagggctaactaggaaaagggggaccccgtggcgtgagatcggacatggggggcacagcaggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccttcagaacagccatctgtgcccagctctgcaggccaggcacacccagctgagcccggggccagccagcaccacccaccagctggggcctgtgggtcccggagaccgtctgtggttgtggctttgtcgccggattgcagagctgaagggagccctgtggatgacaaacaccaggggcctctccagaccctacgtggggggagggctgaacaaagcagggaggcccacggttagacaccaggcagaactgcccaggagagacacagggacaatcagaccagcgtcctcgaggttagcctgaggcgggtgggcacggccgaccatccacccggtggttcctgtttgtcccaccacttaactgg

SEQ ID NO: 1207 - DNA, 2551 bp, Homo sapiens
agaggtaattatagcctggccgctgccagctggcccagctttgcgatccagcagagagggctggagacgggacgaaggccacaacagacccggccctgccagcgggcggtggcgcctccagatcagagccctcgggaaggaggcctgggcgggcctggcccgttcacctgtgtgccctgcagttctgcccgaggctcaactctcaagggcctgggaggggtgctgccggccaagagggtccaggacctcactggactgtgccccacagggagatcccgaagagcctgtttctgtccctcggggagccaggagggaaccaggaccatgttccagtaaatgaggactgcagcaggagccgtgagccctgactcccggccagagacacgacgtcagaccagaaagaatgaggaggccgcgtggggcccgcgggtgtgcagggcagagagggaggacaacaggaagtgccccccctccatcctgaaacggagccggccggagcaccaccgcccagaggccaagccccagaggacctcgaggcgcgtgtggttccgagaacccccagcggtgaccgtccactacattgctgacaagaacgccacagccactgtcagggtgcccggccggcccaggccacacggcggctccctgctcctgcagctgtgtgtgtgcgtcctgctcgtgctggccctgggcctatactgcggccgggccaagcccgtggcaacggcactggaggacctgcgggcccggctcctcggccttgtcctgcacctgcggcacgtggccctcacctgctggcgcggcctcctgcggctctgacgggcaggacgggcaggacgggcagggcttccaggagagctcaagcactccgggggctccgagacagcctgagccctggccctgctgcttggtgaatcatgggggccaaaaggggctgctgcctgagggctaactaggaaaagggggaccccgtggcgtgagatcggacatggggggcacagcaggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccttcagaacagccatctgtgcccagctctgcaggccaggcacacccagctgagcccggggccagccagcaccacccaccagctggggcctgtgggtcccggagaccgtctgtggttgtggctttgtcgccggattgcagagctgaagggagccctgtggatgacaaacaccaggggcctctccagaccctacgtggggggagggctgaacaaagcagggaggcccacggttagacaccaggcagaactgcccaggagagacacagggacaatcagaccagcgtcctcgaggttagcctgaggcgggtgggcacggccgaccatccacccggtggttcctgtttgtcccaccacttaactgggagacactgttttattaaaacacaccgtggcttccttcagtcttggtgtttttatagaaatgagagaaaccagaaccgatttgctaaggaatcggcctcagtggccaaagcggatgtcctgggcgcctggaacctccccatctcctgcaggcctgggagtggatgtgtccactcgggcaggggctgaccaagcccctgggtcttgagggatgcccggccggctccctttgccctgcagtcagggtgtgtccctgcaactccaggtgccagggaacaggtgaagtggtctccagggtcacttccagctttggaatccagggagcccagagttgcgggtggaggtaacaaaaggggctgtttccagaagtggcccagaagggaccatggtgggggctcccccggggaccctccagcatctctccccaggcccagcccatcccaccccaccccaggaaggaggatgggcaggttcctgccccatattctggatgcagaagcagcggctcccagaggttgggtctctcagagcagtcacaggcccaggctcagccctgtgtgcttgggacacccctccagccccggttctgacgggggacaccgcacaggccgatctcccccagccgctgctgtctgtccactgcaaaggcaacgcaaggacgtgcctggctttgcggggtcccacgctacgacctcaggtgttttcgaat

SEQ ID NO: 1208 - DNA, 6495 bp, Homo sapiens
ctccccctagcgtcccagacagcggagggagtcgccgccgctaccgccgccgccgccgcagggcccgccgctgggatgccgagcgcccgcgccgccgctgcctctgtcctccgcgcgctgctcagctgaaggcgcacaggattcaattactggacttgtcaactctgccagtgtacgtgccatttctcttccactatgagaggaccgattgtattgcacatttgtctggctttctgtagccttctgcttttcagcgttgccacacaatgtctggccttccccaaaatagaaaggaggagggagatagcacatgttcatgcggaaaaagggcagtccgataagatgaacaccgatgacctagaaaatagctctgttacctcaaagcagactccccaactggtggtctctgaagatccaatgatgatgtcagcagtaccatcggcaacatcattaaataaagcattctcgattaacaaagaaacccagcctggacaagctgggctcatgcaaacagaacgccctggtgtttccacacctactgagtcaggtgtcccctcagctgaagaagtatttggttccagccagccagagagaatatctcctgaaagtggacttgccaaggccatgttaaccattgctatcactgcgactccttctctgactgttgatgaaaaggaggaactccttacaagcactaactttcagcccattgtagaagagatcacagaaaccacaaaaggttttctgaagtatatggataatcaatcatttgcaactgaaagtcaggaaggagttggtttgggacattcaccttcatcctatgtgaatactaaggaaatgctaaccaccaatccaaagactgagaaatttgaagcagacacagaccacaggacaacttcttttcctggtgctgagtccacagcaggcagtgagcctggaagcctcacccctgataaggagaagccttcgcagatgacagctgataacacccaggctgctgccaccaagcaaccactcgaaacttccgagtacaccctgagtgttgagccagaaactgatagtctgctgggagccccagaagtcacagtgagtgtcagcacagctgttccagctgcctctgccttaagtgatgagtgggatgacaccaaattagagagtgtaagccggataaggacccccaagcttggagacaatgaagagactcaggtgagaacggagatgtctcagacagcacaagtaagccatgagggtatggaaggaggccagccttggacagaggctgcacaggtggctctggggctgcctgaaggggaaacacacacgggcacagccctgctaatagcgcatgggaatgagagatcacctgctttcactgatcaaagttcctttacccccacaagtctgatggaagacatgaaagtttccattgtgaacttgctccaaagtacgggagacttcacggaatccaccaaggaaaacgatgccctgtttttcttagaaaccactgtttctgtctctgtatatgagtctgaggcagaccaactgttgggaaatacaatgaaagacatcatcactcaagagatgacaacagctgttcaagagccagatgccactttatccatggtgacacaagagcaggttgctaccctcgagcttatcagagacagtggcaagactgaggaagaaaaggaggacccctctcctgtgtctgacgttcctggtgttactcagctgtcaagaagatgggagcctctggccactacaatttcaactacagtcgtccctttgtcttttgaagttactcccactgtggaagaacaaatggacacagtcacagggccaaatgaggagttcacaccagttctgggatctccagtgacacctcctggaataatggtgggggaacccagcatttcccctgcacttcctgctttggaggcatcctctgagagaagaactgttgttccatctattactcgtgttaatacagctgcctcatatggcctggaccaacttgaatctgaagagggacaagaagatgaggatgaagaggatgaagaagatgaagatgaagaagaggaagatgaggaagaagatgaggaagataaagatgcagactcgctggatgagggcttggatggtgacactgagctgccaggttttaccctccctggtatcacatcccaggaaccaggcttagaggagggaaacatggacctgttggagggagctacctaccaggtgccagatgccctcgagtgggaacagcagaatcaaggcctggtgagaagctggatggaaaaattaaaagacaaggctggttacatgtctgggatgctggtgcctgtaggggttgggatagctggagccttgttcatcttgggagccctctacagcattaaggttatgaatcgccgaaggagaaatggcttcaaaaggcataaaagaaagcagagagaattcaacagcatgcaagatcgagtaatgctcttagccgacagctctgaagatgaattttgaattggactgggttttaattgggatattcaacgatgctactattctaatttttattttggagcagaaaaaaaaaaagaacaacctgccacattgctgctatcaggccgttagtcctagtgtctgctgggtgctgggtagtagatttttcttgtactgagcagaaatggcatgttgtatactaaacgtatcatgcagtatttggttttattctgtagtgaattttccacaaccgtgggctacaactcataaatatgcaacatatatgtttttcagtaggagttgctacattaggcagagtaaatattttgtagttttccacagtgtcttttccttggtttgaattacctgcattgagaataatgattgttgccaccaaggcatgcttgactctgagatataaatcttaacaaagaataacttctcaagatatactctacctacttgaaaccacagggttgtgggccatggtacatactgcatttgcatcaaactagcagtaactcagaatgaaatcattttcattaagaagctctctcagcatattaggattatatgtagatttgtatgtattttgcattatgtacttcagtctcctagttttattattctcaccttccgttttattcttggcgaggaaaaaaatgcactagaaataatacattaaactgactcttagtcttaatgtacgtttgctgtcttaaatagtgtgattgagtccaacagactcaatcatacatgtcatacatgtttatgattaagagatattctttttgtgtgctagttgattttgccgagaaaaaatgaagaagaattcaagaatgagatgagggtaggtaagctctcagagcatttctgtctgccatttggttctatgcttatgtggctgctaatgtgactaattcagagtgttgtatttccacatctgtggactccaccatggaaaaggtgggctaccattggtccttatatggctttattagaaaaatagacattctatcgtttgtctgcccagtggccagagtcctggtgaacaacagagctcatgggaaaccagcctctctcagggcaccccgctatgaggatattgaaatatgttcaatcatttctcatctcccttggaatgtaattccctgccctatacaaaataggatattccaatgcgctatttgaatctagggattgaggatttgtagttgagttttggggtaaaggcttggctcattgccatggaagaataaaagttatttattaatagtgctgtcactgtggagtacttgttggtgtttattagaagttgtctactatgttcaagaaaagttgcacagttattcctcagagctactatgtgaggtaggacatatgtttttattctcccatttgactgaagatggaactgaagcagagaagtgaaatgattttccaaagttgtacccagagagaatcagcgtgagaacccacttggacccagccatgcacccttatcttcagttcagtaaccttttcatagactttggtggaagcagtgacatttcagggtccttctttaaaacaaaggttctaagggaatagcagggaatagctgcctggtcaaggaacgtttgatgtgaatttccatctttgttaaatgaatgatgcctttctaatttctctcttactcacacacaagttctttccttccccatctcagttatcagttatttcctttacagtcatacatttgagtatcacctctatggaactaataaaccttcctagaatccgtttttgaataatgtctggctcacaagaacattttcatcaaataattttaactctttttgccaagagatgtaagcaaatatgtgaaactgatcaagagaagtgaaaagctctgtacagtcaaatagaagttagcaactggcaaattagctcaaggtcagattttaaaaatagaattcagaatcatgacactcagaagtgatttgtaatttcacgagtagagacatcctgatattgcataagggatgttttccttttctaagagcagccctttgctgtaagtgtttctaaggttgggagtaagtgagcatggtgtggcattactgtctttgtattcttgacaaactatttgttgagaatacgtcgtaggccacttaactgagtagcacatgggtgatactagtggccattattgccttgggctactcaatctatagtcttaactaaaccatggctaataggttgaatcttcaaactgtagtgtaataaattcccaaataacagacccatattttcatttctcagaggtccgtgaggatgacatgtatgtgaattttggcttaacacagtatctctgtggtcctttttgggacacatgatttcttaaaggaaaagattatacttagagtacatttctgtacaaacccatttaaacatctggattgagtggaaggtcggtggatggtacaaatgacatgtttattttggccattttccttgctgctggtggctgtggaataatgattttcagtggttggcttagattattaagaggatcagaaaaggttgtcatattttaaacaaaacctgggattagagatgctgctacgagatggaagtgctggccagtggttatatagtggtccagttgagaagtagtaaatcaggcacttgtaggtttacccaaaataagtgacaagtatgcttatatttgcacaattaaaatagaaagtcaactttttattcaaacaactaggcttaaaacatttaacagtgaaacaaataaagctgtctggaaaggagggctgattcctgcagcttcagttgtgaacaccatccccactggactgagtttacccagccagaactgccagcatcccaccgcaggggcaggaactaggtcttcttctcggagggagaggcagtgtttccagaatttgcaggctcataaaaatcacctgggacacttgtgaaacatacagatctcaaggccttgccccagacctgatgagttagaatctccagggaaggagcttggggtattcatgccccagcaagcttgggaacacagctaggagggatctatctagagaaccacttccttatgatagagacaaggtcatttaaagtcacaatgagataccacctcacacctattgggatggctattattcaataaaacaaaatataacaattgtttctgaggatgtggagaaattggaatccttgtatactgtgggtgggaatgtaaaatggatagccactgtggaaaacagtatgaagattcctcaaaaaattaagatagaactactatataatccaactatcccacttctgggcatatatccaaaagaatagaaatcaggatcttgaagaagtatctgtacgcctgtgttcattgcttatgcttataagcatattattcacaataagcttataagtattattcacaatagccaagatatggaaattgcattgatagatatgcaaatatctatcaatagatgaatggataaagaaaatgtggtatatacatacagtagaatattattcagccataggaaataaggaaattctgtcattgtgacaatatggatatacatggagaacattatgctaagtgaaataaactagtgacagaaggacaaatgcatgattgcacttctttgaggtatccaaaataatcaaactcataagggcagaggcaaaatggtgcttgccacgggctgggcaaagttaaaggtggggagatgttgattaattatgtttcagttatgcaagatgaataagttctagagctctgctgtataacatagtgcctatagttaacaatatcgtactgtgcagttaaaaatttgttaagagggccgggtgtggtggctcacgcctgtaatcccagcactttgggaggccaaggtgggcagatcatgaggtcaggagatagaaaccatcctggctaacatggtgaaaccccatctctactaaaaatacaaaaaa

SEQ ID NO: 1209 - DNA, 1155 bp, Homo sapiens
cagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaatcaaa

SEQ ID NO: 1210 - DNA, 2520 bp, Homo sapiens
cgcgggctcggccaagccgccggcgcgaggcctcgcgcgcgcccccgagcgcggtgggcggaggggcggagggagcggcggggccgcgagggggcgggggggcggagaggggagccccgggagcgcgagccgcggccggcgccgctgcagagccgagcgaatcccgagcccgggcagcagggcactatatttgtatgtgtcttgtagaacccacgcttggaaatgctgacagcaggcttcaggacagctgagccccactaaacaccaagaaaacccatggctgtggctccatctttcaacatgaccaatccacagcctgccatagaaggaggaatttctgaagttgagatcatctcccaacaagtagacgaagaaaccaagagcattgctcctgtgcagctggtgaactttgcctatcgggacttgcccctggctgctgtcgatctctccacggcgggctcgcagctcctgtcaaatctggacgaagattaccaaagagaagggtctaactggctgaagccgtgctgtgggaagagagcagccgtgtggcaggtatttttgctcagtgcaagtctcaacagtttcctggtagcctgtgtaatattggtggtgattctcctgactctggaacttctaatagatataaagcttctccagttttccagcgcattccagtttgctggcgtgattcactggatcagcctggtcattctgtccgtgttcttctcagagactgttctacggattgtggtgcttgggatctgggattacatcgaaaacaaaatagaggtgtttgacggggctgtgatcatcctatctttggctccgatggtggcatccactgtggccaatggacccaggagcccctgggacgccatcagcctcatcatcatgctccggatctggagggtgaagagggtcattgatgcctacgtcctgccagtgaagctggagatggagatggttatccagcagtacgagaaggccaaggtcatccaagacgagcagctggagaggctgacgcagatctgtcaggagcaagggtttgagatccggcagctgcgcgcgcacctggcgcagcaggacctggacctggctgccgagcgcgaagcggcgctccaggccccgcacgtgctcagccagccgcgcagccgcttcaaagtgttggaggccggcacgtgggacgaggagacggcggccgagagcgtcgtggaggagctgcagccctcgcaagaagccacgatgaaggacgacatgaacagctacatcagtcagtattacaatgggcccagcagtgacagcggtgtcccagagccagctgtgtgtatggtcaccacggccgcaatagacattcaccagcccaacatctcctcggacctcttctctctggacatgcccctcaaactcggcggtaatggcaccagcgccacctcggagagtgcctcccgcagctcagtcacccgggcccagagtgacagcagccagacgctgggctcctccatggactgcagcactgcccgcgaggagccgtcctctgagcccggcccttctcccccgccgctgccatcccagcagcaggtggaggaggccacagtccaggacctgctgtcctccctgtcggaggacccctgcccttcccagaaggccttggacccagcccccctcgcccggcccagcccagcgggctcggcccaaaccagccccgagctggaacacagggtaagtctgttcaaccagaagaaccaggagggcttcactgtctttcagatcaggcctgtcatccacttccagcccactgtgcccatgctggaggacaagttcagatctttggaatccaaagagcaaaagctgcacagggtccctgaggcctagagcctgccatgggctgggtgagatgaggggagacagccatctcaaagctctcctgggaccctggaggctgccaagggccacacgcggggcccaggagcccacctggcctccctcagggtgctgcctgcctccagggaggcgacgccaggccaggaggccacaagcttcagacctcaaagcccagagctggcgcctcttctcgccctgctcaggggagggtggtgctcgtggctgggttttctttttaaccatttttacaaaaaccagcctgtggcccagcttcagcagggtagagtgtgggggggccagctcagcctcttgcgttgccttcgttcctgacgcccaccctggactctagggaacagcactgtgagcaggggctgtccagccccacccctaagccgtctttcccaggaatcctgggtggagtccaacacaatcacacggagaccaccatctgagcctatgtcatttgtcctcattctcattccagcatgagcgtttctgagtctcttcaagacgaatctagttttcaccttcacaggatataaagggatcaacctagaggtgggtgggagggtcctagagggcaggggaacaaccattttccaaccttggctttaataataaaaaccagctgcactgaga

SEQ ID NO: 1211 - DNA, 875 bp, Homo sapiens
gttcggttccgggcgttaccatcgtccgtgcgcaccgcccggcgtccaggtgagtctcccatctgcagagacgcggacgcgccggcccgcagttggcctgcggagcgcggtggacggtttggcgcccaccaggcgatcaatactttggatttttaatttctagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttctcaaagattaggtatatatttaaatggaagagaaaatatttttatgggagaaaaatacatttgaaccatgaaatttcatcttttaaataacatccagtacagatttctgtgtaa

SEQ ID NO: 1212 - DNA, 732 bp, Homo sapiens
gcgtgaccagagcgcgctggcccggcccacccggggcggttgtggtcgctatatataaggtggggaggccgccggcccgttcggttccgggcgttaccatcgtccgtgcgcaccgcccggcgtccagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttctcaaaga

SEQ ID NO: 1213 - DNA, 2485 bp, Homo sapiens
catctccaccgccacaaacagccaggccactcatcagagtccgggagccactggcagagagggcacggccccacactgccccagagacatataggagccaggcaaacaccagggcgagtgagctcgggccatctgctgcctgcctgtggaaggagcgctcgccagcctcacccagcccgagaaggtccacctctgcctccgccggagctgccctcattctggctccagtaagtgctgcttcttcctcctgggtttttttccactaccctattcagtaaccaggccactcctgtccctgtgggaaactcttgctgccaggaactcccagctgtctgctctcctgggcaaaaaagttccttcttcctgagccctcctctcaccatccaagatgtggtcaaaggtctgtgctgagtggaaaccctgaggcctctgctcctaggggagcctccccagctgctggcactcactgccccagcagggaccacatgcaccctggctgctcctgaacacctgtctgctggctcccctgggccccatggagacctggcggaaaggctccttccgcaacgcctccttcttcaagcagctgagcctggggcggccacggcggctccggcgacagagtagtgtgcttagccaggccagcacagcaggtggggaccacgaggagtacagcaaccgagaagtcatccgggagctacaagggaggccagatggccggcgcctgccactgtggggggacgagcagccccgggccaccctgctggccccacccaagcccccacgcctctaccgagagagctcaagctgccccaacatcctggagcccccacctgcctacacagcagcctactctgccaccctgccatcggcgctctctctgtcgagtgccctccaccagcactcagagaagggccttgtggacactccctgcttccagaggacacctaccccagacctcagtgatcccttcctctccttcaaagtggacctggggatttcacttcttgaggaagttctgcagatgctaagggagcagtttcctagcgagcccagcttctaaatggggtgagggtgggcaaagccggggtgactggaagatccagaggctggggattaaggaaaggacagggacaggactccaggcccatcgctggagggttcaggcaggcagagcttcttcatcctgggggaggattccaggataggaatccagggctctgcctgctctctgggtcctggacagtccttccaggcaccccagagtggagggacagaggcaatctggaaatgttgggggggcggcccttcctggcaggaccctgaagaaagctggctatgccgggaaagggaggctgtgccgggaaagggaggctctgtgcggcactacaggaaccaggtagaggctggcagagccagaaggtggcacggggtcagatcagggagtgggaggacacagactgagcagaagagatgagtgccccatgccagcctctttggaagccactgtcaacagagagaggtcacaggacaagcttgggtaaaggcagtccaacccaggcagaagaggaaagtgggaaggcccaggaagaaaggggagaaggcctgaccctgtctaatctggtggccactcactgcatgacactgaattgaaataaataaaattaacagttcagttcctcagctgcaccgttattccagattccacattccaaatgcccggtggccacacatgattaatggctaccacactggtcagtgcagaatggacgtaaacatcgctgcacaaagttctaatggacagcgctgtctagaccatggcctggagccaccagcaaaggggaggcgcatacaggggctggccacataggaagagataggtagagatagagtataactcaggaaaaagaccaggcaaatccttagcagaaatgaggacgtggctcagtctgccaacacagctacccggagcaatccctggtgaaggaaggcagctctagagaatgccagccacaggcacgcgcacggcttgcaaaggggtactttggggaattcccagaattactagtgatgggagccctggcaggtttccttcctcgaagagaggagaactggatccagggatgggcattcaacagcgaagcggcacagctggtttccagaaccgtctcccgggattagacagttctgccgcctgaaccctccgacgatgggcctgccaaccaggccaagcccactgggtcaaagccacaggctgtgctacggccccaccccatggcctcaccagaacacagaaaccagagcccagcagcactggctgggccatgtgttggtggccccccgggactcgctaagagtagcaaaggggagagggaagctctgacacacaccatttctacgacctaaatcagtggcctccctctttcctcctcttgtgtataggtaccgagctgtggatacaggagagaatgaataaaattctaac

SEQ ID NO: 1214 - DNA, 2451 bp, Homo sapiens
agccaggccactcatcagagtccgggagccactggcagagagggcacggccccacactgccccagagacatataggagccaggcaaacaccagggcgagtgagctcgggccatctgctgcctgcctgtggaaggagcgctcgccagcctcacccagcccgagaaggtccacctctgcctccgccggagctgccctcattctggctccagtaagtgctgcttcttcctcctgggtttttttccactaccctattcagtaaccaggccactcctgtccctgtgggaaactcttgctgccaggaactcccagctgtctgctctcctgggcaaaaaagttccttcttcctgagccctcctctcaccatccaagatgtggtcaaaggtctgtgctgagtggaaaccctgaggcctctgctcctaggggagcctccccagctgctggcactcactgccccagcagggaccacatgcaccctggctgctcctgaacacctgtctgctggctcccctgggccccatggagacctggcggaaaggctccttccgcaacgcctccttcttcaagcagctgagcctggggcggccacggcggctccggcgacagagtagtgtgcttagccaggccagcacagcaggtggggaccacgaggagtacagcaaccgagaagtcatccgggagctacaagggaggccagatggccggcgcctgccactgtggggggacgagcagccccgggccaccctgctggccccacccaagcccccacgcctctaccgagagagctcaagctgccccaacatcctggagcccccacctgcctacacagcagcctactctgccaccctgccatcggcgctctctctgtcgagtgccctccaccagcactcagagaagggccttgtggacactccctgcttccagaggacacctaccccagacctcagtgatcccttcctctccttcaaagtggacctggggatttcacttcttgaggaagttctgcagatgctaagggagcagtttcctagcgagcccagcttctaaatggggtgagggtgggcaaagccggggtgactggaagatccagaggctggggattaaggaaaggacagggacaggactccaggcccatcgctggagggttcaggcaggcagagcttcttcatcctgggggaggattccaggataggaatccagggctctgcctgctctctgggtcctggacagtccttccaggcaccccagagtggagggacagaggcaatctggaaatgttgggggggcggcccttcctggcaggaccctgaagaaagctggctatgccgggaaagggaggctctgtgcggcactacaggaaccaggtagaggctggcagagccagaaggtggcacggggtcagatcagggagtgggaggacacagactgagcagaagagatgagtgccccatgccagcctctttggaagccactgtcaacagagagaggtcacaggacaagcttgggtaaaggcagtccaacccaggcagaagaggaaagtgggaaggcccaggaagaaaggggagaaggcctgaccctgtctaatctggtggccactcactgcatgacactgaattgaaataaataaaattaacagttcagttcctcagctgcaccgttattccagattccacattccaaatgcccggtggccacacatgattaatggctaccacactggtcagtgcagaatggacgtaaacatcgctgcacaaagttctaatggacagcgctgtctagaccatggcctggagccaccagcaaaggggaggcgcatacaggggctggccacataggaagagataggtagagatagagtataactcaggaaaaagaccaggcaaatccttagcagaaatgaggacgtggctcagtctgccaacacagctacccggagcaatccctggtgaaggaaggcagctctagagaatgccagccacaggcacgcgcacggcttgcaaaggggtactttggggaattcccagaattactagtgatgggagccctggcaggtttccttcctcgaagagaggagaactggatccagggatgggcattcaacagcgaagcggcacagctggtttccagaaccgtctcccgggattagacagttctgccgcctgaaccctccgacgatgggcctgccaaccaggccaagcccactgggtcaaagccacaggctgtgctacggccccaccccatggcctcaccagaacacagaaaccagagcccagcagcactggctgggccatgtgttggtggccccccgggactcgctaagagtagcaaaggggagagggaagctctgacacacaccatttctacgacctaaatcagtggcctccctctttcctcctcttgtgtataggtaccgagctgtggatacaggagagaatgaataaaattctaacacaa

SEQ ID NO: 1215 - DNA, 2585 bp, Homo sapiens
aggcggaccgccctgcaccctccaagcctgcacctcttagtccagcaccaggaagagtggctctaggagggagaggagcccagggactgacccaagatgccgttgactccagagccgccctctgggcgcgtggaggggccccccgcatgggaagcagccccatggccctcactgccctgtgggccctgcatccccatcatgctggtcctggccaccctggctgcgctcttcatcctcaccaccgctgtgttggctgaacgcctgttccgccgtgctctccgcccagaccccagccaccgtgcacccaccctggtgtggcgcccaggaggagagctgtggattgagcccatgggcaccgcccgagagcgctctgaggactggtatggctctgcggtccccctgctgacagatcgggcccctgagcctcccacccaggtgggcactttggaggcccgagcaacagccccacctgccccctcagccccaaattctgctcccagcaacttgggcccccagaccgtactggaggtcccagcccggagcaccttctgggggccccagccctgggaggggaggccccccgccacaggcctggtgagctgggctgaacccgagcagaggccagaggccagcgtccagtttgggagcccccaggccaggaggcagcggccagggagcccggatcctgagtggggcctccagccacgggtcaccttggagcagatctcagctttctggaagcgtgaaggccggaccagtgtggggttctgaatccccagggttccccagagatccccgaggcaggccttgcctcagtgggaccggggaccccaggatccagcattaggattgagactgccccagcgaagatgcccttcccaggctccttccacctggagtccccctccccgggtctgggtggtggccaggctatgtggactaggggaagcccagcagtgcctctgctcagctacctgggctgtggctcagagacctgggggtggagccaatgccaggccagaagccttcaagatcgcatccagatgaagaacccaaggtactagatagtcaggaaatggcatcgaccagccacctccaccttctttcagtgtttaccgaagccaccaataccaaagagaacgggtcctgcggtgctgaacagcctcggtgtggcgatgacagctggcaggagatgacaggaatccagtttcccagagccacaaatcctgttctccttggccactcacccactgtgaggtcctctaggaaaatacacaaagagaggaccagaccaggcagaggaacattttgtttcatatgaactgtggctttgacccccaaactgcaaggaggaacttgctgggccaagctgcagcggcgctgtcttgctggagtggggacctagagtcagagaaaacccacaggctcctctgcccattctcctccatctgcacacgtctcagcctcggaccctcaccactccatggtgaggaaggccatggccaggggaaactgagtttcatccaatgtggagaggagcgttgtcctagagcagggcaactcccaaactgtgacctctgatcatcgtcccttccagcttgctggagtgtccagagagacagatttgccacaagctaggcttacttataatgctccaccctacagaaatgggaccccaagtacccaatcttccctttaggagaggcaggcaggtgggtgagcagcagatgtagtttccatttccctgggggtttaattttccaaactttgtcttttttttttttttttttttttttttgagacagaatctcaactctgtcacccagactggagtgcagtggcacaatctcaactcactacagcctcgaactcctaggctcaagcgatcctcccacctcaacctctagaatagctgggactgcaggtgcataccaccacgcccagctaatttttgtattttttttgtagagacacggtctcaccatactgcctgggcaggtttccaactcctgggctcaagtgatccagcagccttagcctcccaaaatgctgggattacaggtatgagcactgcacccggccacttttttttgtttttgaaacagggtctcactctgttgcccaggctggactacagtggcacaatctcagctcactgcggccttgaactcctgggcttaagtgatcctcccacctcagtctccctagtaggtggaactacaggcatgtaccaccacacctggctattttttttttttagagacagggtcttgctatgttgcccaggctggtctttaattcctgggctcgagagagccactcatccccatctctcagagtgttgggattacagccatgagccaccatgcccggccaaacttcagccttgaatattagtgattttgccatattagtttaccatctgtacaattatttgctttatatttttctttaaattggctcattattcacttaatgaaattattgcaacaggaatcttttgtatcacttctgtaaatggaaaaccagtctcatttgccatcaatagaaggtaaaacatgaaaataaatacaatgtaaacaaaa

SEQ ID NO: 1216 - DNA, 2793 bp, Homo sapiens
accgtgcggcaggggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 1217 - DNA, 981 bp, Homo sapiens
aaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtgaccctgcccctggtctcgggtcctgtgtctcaacctctcccactgcctaggcatcctgaccccagcttcccacaggtttctggccagctccgtctctatccctgggggtccccttacaccgctt

SEQ ID NO: 1218 - DNA, 1842 bp, Homo sapiens
aaaagctcggcatggctgacgacgcgggtttggagaccccgctgtgttccgagcagttcggctccggggaggcacggggctgccgcgccgccgcggacgggagcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcggg

SEQ ID NO: 1219 - DNA, 1056 bp, Homo sapiens
aaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaaggtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctgggtaagccggaagcagggtgggcaggagaaccccagctgggcctctgcccacttcagctacctcactctctcaccccagcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtgaccctgcccctggtctcgggtcctgtgtctcaacctctcccactgcctaggcatcctgaccccagcttcccacaggtttctggccagctccgtctctatccctgggggtccccttacaccgcttggtctccaggtgagtggccta

SEQ ID NO: 1220 - DNA, 3548 bp, Homo sapiens
gtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaagaagcagtctctgtgttgtctttgcacaagtggccttcggtctactcagcccgatctgatgggcctttttagcaagagagaaacaagaatgcaagtaacatctttcttctctggaaggtgtttgttttttcatagtttagaaataaggactttaaaagtggactgcttttcaaagtgccactgttccagacccattccattccagactttgtaccttaaagttagagcacacccaaagtctggaactgtgttacctgaacccctatggaggatttataaaaggcagaaatagcactccattaactctttttcctatcaaaagcagctcttgattggacttagaatctgtgttggtggatcaaaggagaaagcgaggtcaaatttgagattctctgtggcttcagtatacagtaactgaataaatgtcctgaagg

SEQ ID NO: 1221 - DNA, 2836 bp, Homo sapiens
gtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatgcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaag

SEQ ID NO: 1222 - DNA, 3415 bp, Homo sapiens
atagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtctgcagaaggtgctgtgcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcact

SEQ ID NO: 1223 - DNA, 2650 bp, Homo sapiens
atgcctccactgggggtattggtgcacgagaaaagccacctgtgtgacgtaaattcattctgtttaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccaggctgagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggtgggaatggaagtggccccacatctcaaagaaaccctaaataagaacttttttgacttcctccttacgttcaaacagattcatggggatacggtccagaaccagctggtggtccaaggagtggagctcccatcttacctccccttgtacccgcctgccatggactggatcttccagtgcatctcctaccatgcccccgaggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatagtgtgaaccggttggcaatggagacaagaaaagtaatgaaaggaaatcattccagaaagacagctgcatttgtccgggcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcact

SEQ ID NO: 1224 - DNA, 1325 bp, Homo sapiens
atagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtctgcagaaggtgctgtgcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaagatggaggttacagtgagccgagatcgcgccaccgcactccagcgtggacgacagagcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggt

SEQ ID NO: 1225 - DNA, 3138 bp, Homo sapiens
tagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtctgcagaaggtgctgtgcggccgctgcggggcggccagctgcccttcacaaacatggcggccgaggggtgcggggagtggcggggtaaggatgggaagccgagcagacggccccagaacaagcggtcatgtgactgggaagatggccgtctttccttggcactccaggaataggaactacaaagctgaatttgcatcatgccgactggaggctgtaccattggagtttggggactatcaccctctgaaacccataactgtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggacagctccagaaggaaacgtgatagagatgataactccgttgtaggatcggattttgagccttggaccaacaaacggggagaaatccttgcccggtacaccactaccgaaaagctgtctattaatctgtttatgggatctgaaaaaggcaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaatcgctgaaggatgcctgggcctcagaccagaaagtgaaggctctaaaaatagtcatccagtgttcaaagcttctttcagacaccagtgttattcagttctacccaagcaaatttgtccttatcaccgacatacttgatacatttggaaagctcgtgtacgagcgcatcttttccatgtgtgtggatagccgcagcgtcttaccagatcacttttctccagagaatgcaaatgacacggccaaggaaacatgcctaaattggtttttcaagattgcctccatcagggaactcattccaagattttacgtggaggcatccatcctgaaatgtaacaaattcctctccaaaacgggaatttcagagtgcctgccccggttgacatgcatgatcagagggatcggagacccactagtgtcggtgtatgcccgtgcctacctgtgccgggctctgctgaccgagatgatggaaaggtgtaagaaactaggaaacaatgccttgctgttgaattctgtgatgtctgccttccgggctgagttcatcgccacaaggtctatggatttcattggcatgattaaagagtgtgatgaatctggtttccccaagcatcttctttttcgatcactgggattaaacttggccttggctgatcctcctgagagtgaccgacttcagattctcaacgaagcttggaaagtcatcactaagctgaagaacccacaggactacattaattgtgccgaagtgtgggtggaatacacctgcaagcatttcacgaaacgagaggtgaataccgttttggcagatgtcatcaagcacatgactccagatcgtgcatttgaagattcctacccccagcttcagttaataattaagaaagttattgcccacttccatgacttctcagttcttttctcagtggaaaaatttctgccgtttctggacatgttccaaaaagagagtgtgcgggtggaggtttgcaaatgcatcatggacgcctttatcaagcatcaacaagagcccaccaaggacccggtcatcttgaatgcccttttgcatgtttgcaagaccatgcatgactctgtgaatgcactcactcttgaggatgagaaaagaatgctgtcatatttgattaatggatttataaaaatggtttcctttggccgtgattttgaacaacagctgagtttttatgttgagtccaggtcgatgttttgcaatctggagcctgttcttgtgcagttgattcatgcctgtgttgcctactgcttcatcaccatcccctccctggcgggcatcttcacacgtctcaatctctacctgcattctggtcaggtggccttggccaaccagtgcctctcccaagctgatgcttttttcaaagccgctataagccttgttccggaagttccaaagatgattaatattgatgggaagatgcggccatcggaatcgttccttctggaattcctctgcaatttcttttctactttattaatagttccggatcatcctgaacatggggtcctgtttcttgttcgagagcttctcaacgtgatccaggactacacctgggaggacaacagcgatgagaaaatccgcatctacacctgcgtcctgcatctcctctccgccatgagccaggagacgtacctttaccacatagacaaagtggactccaacgacagcctctacgggggagactccaagttcctggcagaaaacaacaagctgtgtgagacggtgatggctcagatcctagagcatctgaaaaccctggccaaggacgaggccctgaagcgccagagctcgttgggcctttccttctttaacagcatcttggcccatggggacctacgcaacaacaagctcaaccagctctccgtcaacctgtggcacctggcacagaggcacggctgtgcagacaccaggaccatggtgaaaacgctagaatacatcaagaagcaaagcaaacaaccagacatgactcatctgacggagctggccctcagactccctctgcaaacaaggacctgacccccgggcccatccccaggctcagggactctggtgccaaatccagaaagatctgctctgctgccctgaactcttacggcaatttaggtttctcatttttcttttctttttacatatgtacaaattgttttaagctttggcctctatccaggttattctgacaatgaagaaatgggagttgtcagagcattaaaatgcaatcttcactaag

SEQ ID NO: 1226 - DNA, 2841 bp, Homo sapiens
gtggtgttgggccggtgctgctgccgctgccgccggggaggaggtggaaagcggggctgtggcgggccggcgggggcggcctgtcagccgctgctttgtctccttagctcgggtcccttctgcgctgccgcagggaggccgcccgggccaggcgagccgaaccaatgctggacctggaggtagtgcccgaacgctctctggggaacgagcaatgggaattcacgctgggaatgcctctggctcaggcagtagccattcttcagaagcactgtcgcatcatcaaaaacgtccaggttctctacagtgaacagtctcctctaagccatgacctcattcttaacctgactcaggacgggatcaaactaatgtttgatgctttcaatcagagacttaaggtgatcgaagtatgtgatttgactaaagtaaagttaaaatattgtggcgtgcattttaattctcaggccatagctcctaccattgaacagattgaccagtcttttggcgcaacccatcctggagtgtacaactccgctgagcagctcttccatctcaacttcagaggactgtctttctcttttcagttagactcatggactgaggctccaaagtatgagcccaattttgcccatggcctggcttctctccagataccccatggagcaactgtaaaacgaatgtacatctacagtggcaacagcctgcaggataccaaggctcccatgatgcctctgagctgtttcctgggcaatgtctatgctgagagtgtagatgttcttcgagatggaactggacctgcaggtttacgacttcgcctacttgctgcaggttgtggacctggcctattagcagatgccaagatgcgggtatttgaacgttcagtgtattttggtgattcctgccaagatgttcttagcatgcttggctctccacacaaagtcttctataaatcagaagacaagatgaaaattcattctccttcccctcataaacaagttccatcgaagtgtaatgactacttttttaactacttcactcttggagtggacatcctctttgatgcgaatacacacaaagtgaagaagtttgttctacacaccaattaccctgggcattataatttcaacatttatcatcgctgtgagttcaagatcccactagccataaagaaagaaaacgcagatggtcagacagaaacatgcacgacctacagcaagtgggacaacatccaggagctcctgggccaccctgtggagaagcctgttgtcctgcacaggtcttcctccccaaacaacaccaacccatttggttccacattctgctttggtcttcagcgaatgatctttgaggtcatgcagaacaaccacattgcctcggtgaccctgtatggcccccccaggcctggtagccacctgagaacagcggaactcccctagggacaccaccacccatgcccctctgtcccgtggaactgtgcatcacatcctgctcagtgggcctctgtaccaccctgtgggttttcttggacacctggccagtgctgaagggctgttgtgatgttctgaggttgggctcaggctgggtgctctgccatgggctgagtggcccagatattcttctgtccatctttggcctgctggtgccagcaggggacacagactgcaaagagaagcacaaagtttgagccttgattcctggacccaggagctctcaactaacaaggaggcaggagaggtcaacccttgtcccatgcacattgggaagacttggggctctttctgtgactgaggacacaggcacccaggataaggacaaggtcctgcctttggctccacattgccacatgacccttaaggcaagcaggtagcgtgtccatagtacttggttgcgacatttgcactacatccactttagttacttgatgagctggctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaa

SEQ ID NO: 1227 - DNA, 1071 bp, Homo sapiens
atgggtctcatggtgaggggtggggtcacctgcaggtcccaggaaaggctgctgggagtggggacagggacagcatcggcacagccaccagttacggcttctccttactgctccttcacaggcagaagccgagccgacgccccggcgcgggcggcaggaaatggccagcccaggcttcgggcgcaggtggacctcagctcggcctcgtcggtgctggtcactgtcctggacgccaaggctctgcccctgactctgctgtcctggggcagcttgtgcgcaactgcccaaaaccacaacaaccaggaaggtgcaccagcccaacccaaaggctccatggctaaccagagggcccttcgatttccacctccttcaggaagcccccctgggctgcacaccaggatgaggctgaccagtcctccccaaccacactttgagccccctcctcccacaacagtgggtgctcccaggtccctacagggggactggtttggcagtgattccagggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcggaccagtggttgagacaggaagggagccgacagccgcccttcggatttgatgtcacgtttgcccgtgactgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataa

SEQ ID NO: 1228 - DNA, 913 bp, Homo sapiens
agtcgaggagtcaaggcagcaatgaatcgtgtcttgtgtgccccggcggccggggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcggaccagtggttgagacaggtgtggggagaggtgccagagcccagtgatcgttctgaggagcctgagactccagctgcctacagagcgagaacttgacggggtgcccgctggggctggcaggaagggagccgacagccgcccttcggatttgatgtcacgtttgcccgtgactgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataatatggg

SEQ ID NO: 1229 - DNA, 895 bp, Homo sapiens
aggagtcatgaggctgtggccatgggtgctggtgtgggtgtggctggctgcactaggggccatagaaactgggtcccaagtcagcttccgcctcgagagataaaggcaggggtcagcttggctgttgtcacagagtttgcttgggtcctagcacccagacccaagcgtgccacggcgtcagccctggggacagagtctccgcgcttcttagacagacctgacttcttcgattatccggactcagaccaagccaggctgctggctgtggcccagtttattggagagaaacccatcgtgttcattaactcaggttccagccccgggctcttccatcacatcctggtgggcttgctggtggtggcgttcttctttctccttttccagttctgcacccacataaacttccagaaaggggcctaaagagccggacaagggctctggactcaacctgagcacccacacccacctcctctcctgttgatgagcaaaagttccctgctttcctcctccctgactgcccagcgagcagctggggatcctgtcccctctgtttcccatggcccaagccccccacctcctcccttcccagccccaaagaacttggtggcaagggccttggtggcgttcacgcagatcgtcttttattagcggtctgtaaagcacctcccagggtcccccgaccccagattggaggaagccttgagaggtcagtagcaccagggacatggcagggcccgagggcgcgatgtgcagccgatggtgagggactgggcgccctcgcctgcccccggggttgtcagcactgggaaggcttgggggtagcagccacctccttcccccaacccaacagactagttcaaatttgggtaaataaataaaataaataagattcctc

SEQ ID NO: 1230 - DNA, 4300 bp, Homo sapiens
gattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccaagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggaggaggccccacctgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtacgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttcattcttggctacttacactattcatgataatcacagagatacttggacaaagaaatatatttgggcaaaagcaagaatttccttctttttttttttgagacggagtctaactctgtcgcccaggctggagtgcagtggcgcaatctcggctcactgcaaggtccacctcctgggttcccaccattctcctgcctcaacctcccgagtagctgggactacaggcgcccgccaccatgcccggctaattttttttgtatttttagtagagatgggatttcaccgtgttagccagaatgaagaatttccttctgaagtgggaacatatggctcatgctggtaatcccagcactttgggaggccaaggtaggaagatcacttgagcccaggagttggagacccatctgtgcaacatagtgagacgctgtctgtacaagaaacttttaaaaaatgtagctgggcgtggcagtgtgctcctgtggtcccagctactcggagctgaggcaggacgactgcttgagcccaggaggtcgaggctacagtgagctgtgacggctccactgcattccagcctgggagacagcaagatactgtctcaaaaaaaaatttatcattgaagcctgggcattttaaaaaaataaaaaggtgggaaaatacgtgggcacagcagtgaatcctcacaccctgggctttgcccaagaagtgctcgtgaacctgatgaaagtgtcgggtgtggccgacgtgaggctgttccaggagccacgaggggtgattggttccgctagaaggttccagggaggaactggagtctcaggtgtgtcctctgatgagtgatctatttttaagtaaaagtgtttcattaaagtcaaagatgattattcctttcaaaataaagaatctaggagggcga

SEQ ID NO: 1231 - DNA, 4513 bp, Homo sapiens
gattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggatgtttttgtttccggatgatgtcttgtgggttccaagaagttaatggaccgagagccagtgaagctgctggtgcgaaggctggagtcaggtgtcctccggggactcaccacccgcccgagaggggagagacacatgcgattctggaagctgagagcattgcttattgttgattccttggttgccgtgctgagtcctgctttaaggaagcaggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccaagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggaggaggccccacctgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtacgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttcattcttggctacttacactattcatgataatcacagagatacttggacaaagaaatatatttgggcaaaagcaagaatttccttctttttttttttgagacggagtctaactctgtcgcccaggctggagtgcagtggcgcaatctcggctcactgcaaggtccacctcctgggttcccaccattctcctgcctcaacctcccgagtagctgggactacaggcgcccgccaccatgcccggctaattttttttgtatttttagtagagatgggatttcaccgtgttagccagaatgaagaatttccttctgaagtgggaacatatggctcatgctggtaatcccagcactttgggaggccaaggtaggaagatcacttgagcccaggagttggagacccatctgtgcaacatagtgagacgctgtctgtacaagaaacttttaaaaaatgtagctgggcgtggcagtgtgctcctgtggtcccagctactcggagctgaggcaggacgactgcttgagcccaggaggtcgaggctacagtgagctgtgacggctccactgcattccagcctgggagacagcaagatactgtctcaaaaaaaaatttatcattgaagcctgggcattttaaaaaaataaaaaggtgggaaaatacgtgggcacagcagtgaatcctcacaccctgggctttgcccaagaagtgctcgtgaacctgatgaaagtgtcgggtgtggccgacgtgaggctgttccaggagccacgaggggtgattggttccgctagaaggttccagggaggaactggagtctcaggtgtgtcctctgatgagtgatctatttttaagtaaaagtgtttcattaaagtcaaagatgattattcctttcaaaataaagaatctaggagggcga

SEQ ID NO: 1232 - DNA, 1546 bp, Homo sapiens
cacagccccagcagaaggccctcacctcacaaggaacatgaggcgccttgccgggcgcgcaggccactcccaggtcactcaggattccaagttctcccccaagacgccttcagatgctgagcggcacaagggcctccccagggactggttgcaaagcctcctgctcagcttgagagggccaccagctccccactgtttactgttgttcctgagagaggccagagggagggaccagccagggagtggccagagggacagaaggggtggccttcctgagggcagggtgggtgccccagacctgagagcgctgcaggactcccctccacaggctcaggtggagcctccccagggtcctcctggccaggaaggcagagagccgacttctttcttcagctcccaacccaggcccagcccacggcgtgggagtcggggagagggagaggaggaggaaggaggaggagagagggagcttgtcttgtccctgagcagcgctctcagggcagaggtgaggcaccgggacatgaagttggaggacaagttcccaagcagggcttcctcgggctccccctcgcgacggtaatttgacacttggatctccaggacgaccaacaacaaaaaagccaggcagagacagcagctggctgtcagcagaggagctgggctgaggcgcccaggggagcagcggcgcccacgaaggaagtacgaggacagcacgtggaggctccgcgctggggcactgctgctcagcccccaacacctgagctcccagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagtcatcatccttttcacagctactgttctgctgttgctgctgatagcctgcagctgctgctgcactcactgctgctgccctgagcggagaggcaggaaggtccaggtgcagccgacaccaccatgacggacgggcgatggctgaggagaagctggagaggagatggccaatgccatgacacaggccatcagcctggccctgcagcccttacccctcaagaccaggctcccctggccccagctctggcccagcccaggtacctggacactgacaacttgagccctaccaaggaaacaagggctggtataggtgcaaacctctcatctgccagtggacactgggtgctggggagtcagctgtttcaaagactgggtcaactgcctgggcttcttcgcctacctgcactttttaacaaaacaaggaagtaggggtccccataccttgatggagaacagtccccacctgtgggcaattggcccttggggctctgctgatacatgccaaagaggagcaaggcaatcagaggggctttgtgcaatagcttctgcatccgagctcccgccagagcgtgagcatgtcagtattctagtccagtatttgccagtttccaagtaaaagcttttgtgttacgtg

SEQ ID NO: 1233 - DNA, 2285 bp, Homo sapiens
agtgattggagggcccgggcctggcggaagcggggcagaccgggaggggacctggatcatggctgccgcgccgccgctacgggaccgcctgagctttctacaccggctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacggctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgcgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgctctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatg

SEQ ID NO: 1234 - DNA, 2453 bp, Homo sapiens
agaccgggaggggacctggatcatggctgccgcgccgccgctacgggaccgcctgagctttctacaccggctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgcgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgctctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatg

SEQ ID NO: 1235 - DNA, 1913 bp, Homo sapiens
cagccgctgccaatcggctcgcctctaccaacgccccttaaaggcgcagccactgcctccggagccggggcgaaccaattcctccgttgcggcccccacctgcagtatggagtcgtctcgggggcggcccgggcccgagacggaccttctggctgtagcggaacatcaggccctagtctttggcggcgggccgggccgaacgtcctctgagccgcccgcaggcctccgggtgtccggggaggaagagaccgagaacgttgggggcgcgaaccgccaccccaggacgtccccgaagacgtcaagctgcggcgtcgtccaccggccggaacgggaggctctggagaacgagcccggccctcaagggacgctgtctggggccgggagccgcaggggggcgccgggtgcagagcacgaaccttccctgtcctcccggcacaagaacccggcgccgcccgagggcaagccctcctccgggagggactgccgtcgagggggaccaggcggcgggatggatgttgagcagcaggaggaggaagacaacgacgaggaggcggccgcgggcagcagagccggccgctcgttctccagccgtcttcaggacagccgcagcctggacgggctgagcgaggcgtgcggtggcgccgggtcctcagggagtgccgagtccggcgcgggcggcggacgccgcgccaccatctccagtcccctggagctcgaaggcacagtgagccgccacggcgaccttacccactttgtcgccaacaacctgcaactcaagatccgtctgagcggcgcgcctccacccccgccttctgcccctgcgcggccctgcccagcgcctgcacccacacccacaccggccattcccccaatcgaccccgaggtgctgcgggatctggagcggttgagtcgggagctgggaggccgggtggaccgtctgcttcgcggtctgggtggcgcggtgcaggagctgacggcgctgagcgtgggttgcatccagacctaccgcgatgctgtggactccttaggtgaagccgtggacatgagcatcaagggcatgtacaccctgctggcgcgctgcgaggagctggagcgggctctgcagccggttcaggggctggcgcgccaagtccgggatatccgacgtactctggaggtgttggaggccctgtgcaagtgaccaggaggacaggagaggccggtcctggccagggcagggcccagcaggaccctaaggactcttcagggagtcctggtgggaagtgcccactgaggggaggcctgtgtgttggaggctcttccagatgcgttcagctggcccgtgcccactcgctgggccttaggctggtgtatgtggggaagttctaacggctctcctggtgggaagggatgttgctctgcttgtattcagttggccatctgtagctaccctgttcttcccaactctcctccctagctagagcaccagccctgggaacacggggctttaggtctgcttgaaggtgaggacgtgactcccacatgtaatcaggagaaagggacagaggaagccccagcccccactgtggctatcctgactccagtggccacatctcaggtgccaggggctgtgggagcttgtgccgtccttggccaaacaccccgcaggcaaagatgcacccctgctgatggagagccttctgcttctgccctctggccctctaccataccacttccccagccagaaccggcgtgcagctaggaggaatgggttgcacggcggagggggtgaggtgggaggcgtctcactgctctcagggttcaggtagaatgttgctggttttgaagctcacctgttgtggagtgttctaatcagttttggctttctgagtttttgtggaattaaagtgctgctgctgcgaaggctgaggctg

SEQ ID NO: 1236 - DNA, 486 bp, Homo sapiens
ggcctcttgggtggcctgggcggcgttggtccggtgcgtcctgttctacagctatggccgggccagctgcagctttccgccgcttgggcgccttgtccggagctgcggccttaggcttcgcttcctacggggcgcacggcgcccaattcccagatgcctacgggaaggagctgtttgacaaggccaacaaacaccacttcttacacagcctggccctgttaggggtgccccattgcagaaagccactctgggctgggttattgctagcttccggaacgaccttattctgcaccagcttttactaccaggctctgagtggagaccccagcatccagactttggcccctgcgggagggaccctgctactcttgggctggcttgccttggctctttgagctcccttttgcttaattactgggttttctgggcagttttttttttaaagagttggagtaagaagaggattaaaaaggaaaggcaaataaa

SEQ ID NO: 1237 - DNA, 2081 bp, Homo sapiens
cgcgcgcggccccgcccccgaaagtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 1238 - DNA, 1927 bp, Homo sapiens
gcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 1239 - DNA, 2001 bp, Homo sapiens
gcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 1240 - DNA, 2039 bp, Homo sapiens
cgcgcgcggccccgcccccgaaagtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttgatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 1241 - DNA, 2131 bp, Homo sapiens
cgcgcgcggccccgcccccgaaagtcggctcggctccgctccaatcccggaagtgcgcgcggccccgcccccgccggttcgcgtctctctgctgcggcgcggggaccgctgtgctctcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 1242 - DNA, 2217 bp, Homo sapiens
ggcgaccagagttgctgggcagtcttgggtttagtgccgcaatgctgcacttctgacaggctgcttcctggatccctgcagggacctggccagggcattggccccaggtcacctgtggctttggggagagcagttgcagggctggcctgggctgtgggaggcagctgtgccgttttctgacagccattgggaccgccccagtacccgaagaggtggctgccctgagttgccacgggaaactgcagggtggccctggctcagcagccaaccttggggagacctggaggaacagtgcagtgtaaagatggcctcgcgctgagcgggtccccgcagtcggcactcccaggagaaccagcgggctgtgcatgtgacccgccagcctgcaccgcgggcacgtccttcccacccagaggaccctgcactgccttcagggccacagcagtcctccggggcccagcctcaggcaggaaacagcaaatgcttttgctgccaaccaagtgtggctgtcgctttcgatgatgccagtggcgctggtgcgactgccgggcagcatgtgtgggcggggatggctcggccactgaccgtctccccgcagtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggagtctcgccagccctggactcctgctttgggccacagcaagacctcgggcgagtggagaggcgggccaggccggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 1243 - DNA, 1860 bp, Homo sapiens
gtgacagatgagcagtggtctgtctgcaatgagcatgtgctcaagctaacatggataccatcttggtcttcagcctaatcattgcatcctatgatgccaacaagaaagacctcagagatagcagttgccgactggaacagctgcctgggatcttcccaaaagacgtgagaagcatcagagaattgcaaatgcaagaaactcacacagaaaccaaaaggacaacattcattcaaaaccggactatagctaccctgcagtgccttggctctgacagcaaagtaaaagtcaaccttgtatatttggagagaaggccaaaggtcaagcatattttgaagaacctgagaatcattgctgctccccgcagaaacagctctgcctcctcaagctgtcacctaatccccacatccaagtttcagactggatctcttctaaaaggcaaagcttttttaccagggatctcacaatgtaaagtcctgggggcttcatcagagacttttcccaccactgccccttctataactcctgggaataaagaaggagagaaaactacaagtaccgacacagatgagaacctagagaagagacagaaatggagtattgtggtcaaaattctgattgctgtcaccctgttgctcagtggagttgccattatagtatttgtaatttttgaagtcccatgtccttatcaatgcctaggagccaggaagctgtgccaatgccagtggttgtggagatggcaaaagaagggaggccagccacctgggacagctgaatccaagcctgactctcagccccagaaggttggacaagatgctgccaattcatcaaacccaaagaaagctgcagagatcactgttatccaccagacatacttctgaaaagttctgctctatctcaaagactgaatgatactacacagtcctctccctattaatatgggcacattcttgccaatttcacacttgtatcttcagcagggacattacaatcaaacaccaattcctggttaatgaagggagagtgtgggcttagcagagttaccctcatgcccctatctgagccacaaccttctgtaattcacttcatacatccatctaaatggatacctttccatcccctcaaacgagaacaaaaagtattccctgcaagcactatgaatggaccttactactctctttgacagaagactcaaacacagcctctaagaaacaaggcagctgttagtgtgacatagcttccagctcctctgttatcttcacagctgacttcacactcactggccctcaatagcttagagtgggactcctgatctccctggttgacgtttataaggttttgtaatttagcttctggtactacatgtatctatccacacactgctgaagggaacttgaccctacgcattccaaaagccttcctcataagttatccccaaggggttcagggactacagaccattagtacccaagtgaagtcttctgacgatccagaattcctaaggtggctctgatattatatcatactttaatagagagttgcataccttttggacaaagattccagagcaaaataattatgataatgctgtttctcacaggagaatagctatgagtcaaatctaacctgcttaaataagagtttggtgagaaagtgaaaccacctgatcttgaatcaatgttgaggtgaaaaaggaaatgtcaggagggataagacagggtgaggccctgcttcttttcctaagagtctgaaaccattccatttcattttggtgaaatgtgtctgtttctaagaaattctgttttcttagttctctggttaaaaaaaaaaatacataaactgtatccttctttctttcacttc

SEQ ID NO: 1244 - DNA, 1618 bp, Homo sapiens
gtgacagatgagcagtggtctgtctgcaatgagcatgtgctcaagctaacatggataccatcttggtcttcagcctaatcattgcatcctatgatgccaacaagaaagacctcagagatagcagttgccgactggaacagctgcctgggatcttcccaaaagacgtgagaagcatcagagaattgcaaatgcaagaaactcacacagaaaccaaaaggacaacattcattcaaaaccggactatagctaccctgcagtgccttggctctgacagcaaagtaaaagtcaaccttgtatatttggagagaaggccaaaggtcaagcatattttgaagaacctgagaatcattgctgctccccgcagaaacagctctgcctcctcaagctgtcacctaatccccacatccaagtttcagactggatctcttctaaaaggcaaagtatcaatgcctaggagccaggaagctgtgccaatgccagtggttgtggagatggcaaaagaagggaggccagccacctgggacagctgaatccaagcctgactctcagccccagaaggttggacaagatgctgccaattcatcaaacccaaagaaagctgcagagatcactgttatccaccagacatacttctgaaaagttctgctctatctcaaagactgaatgatactacacagtcctctccctattaatatgggcacattcttgccaatttcacacttgtatcttcagcagggacattacaatcaaacaccaattcctggttaatgaagggagagtgtgggcttagcagagttaccctcatgcccctatctgagccacaaccttctgtaattcacttcatacatccatctaaatggatacctttccatcccctcaaacgagaacaaaaagtattccctgcaagcactatgaatggaccttactactctctttgacagaagactcaaacacagcctctaagaaacaaggcagctgttagtgtgacatagcttccagctcctctgttatcttcacagctgacttcacactcactggccctcaatagcttagagtgggactcctgatctccctggttgacgtttataaggttttgtaatttagcttctggtactacatgtatctatccacacactgctgaagggaacttgaccctacgcattccaaaagccttcctcataagttatccccaaggggttcagggactacagaccattagtacccaagtgaagtcttctgacgatccagaattcctaaggtggctctgatattatatcatactttaatagagagttgcataccttttggacaaagattccagagcaaaataattatgataatgctgtttctcacaggagaatagctatgagtcaaatctaacctgcttaaataagagtttggtgagaaagtgaaaccacctgatcttgaatcaatgttgaggtgaaaaaggaaatgtcaggagggataagacagggtgaggccctgcttcttttcctaagagtctgaaaccattccatttcattttggtgaaatgtgtctgtttctaagaaattctgttttcttagttctctggttaaaaaaaaaaatacataaactgtatccttctttctttcacttc

SEQ ID NO: 1245 - DNA, 2163 bp, Homo sapiens
gcagccggtggcgagtacccctcagtcggacccgtaccaccactacttccggcgtctgctccgcgcccccccatgtcgctgccgccgtggtaccgccctctcgcggctgcgcagtggcaccatcccaaccgcaccgactggtaaccccgcccacgggaagaggcgggctcggagcgggaggagcgactaggagcttctgggagaaaggacctcccctggggtggcagaagcgctcgcctgttcacagccaacggagggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaaggctggatcaggtgcaacaccaccataaggaagagtggattcggtggcatcacgatgctcttcacaggatacttcgtcctgtgttgtagctggagtttcagacgtctgaagctgcagcggtggcgtaagtagtgttgacctggacatcacttaaagctctggaacagcaaagggcgtacagtggagacgactgcaatacatacttaacagtttaaaaatgtataatatttgggacagggagaggggagtgaaaaaaataaagaataaaattattggaatct

SEQ ID NO: 1246 - DNA, 3527 bp, Homo sapiens
ggccgggggttgggcaggggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaactgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaacgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagcagactcttttatactttatggggcatctacatactacttccgccactcttcataataaaattatttgtaaaat

SEQ ID NO: 1247 - DNA, 3635 bp, Homo sapiens
ggccgggggttgggcaggggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaagtttctttgttggaacgaagctcaactcatataaggagtttggaaccccctgccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaactgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaacgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagcagactcttttatactttatggggcatctacatactacttccgccactcttcataataaaattatttgtaaaat

SEQ ID NO: 1248 - DNA, 2100 bp, Homo sapiens
ggccgggggttgggcaggggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaagtttctttgttggaacgaagctcaactcatataaggagtttggaaccccctgccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaagctgcagcggtggcgtaagtagtgttgacctggacatcacttaaagctctggaacagcaaagggcgtacagtggagacgactgcaatacatacttaacagtttaaaaatgtataatatttgggacagggagaggggagtgaaaaaaataaagaataaaattattggaatctaaaat

SEQ ID NO: 1249 - DNA, 1931 bp, Homo sapiens
ggccgggggttgggcaggggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcatcattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcacaagtttctttgttggaacgaagctcaactcatataaggagtttggaaccccctgccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgactttacag

SEQ ID NO: 1250 - DNA, 560 bp, Homo sapiens
ggaagaggacggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgcagcctggggcttactgtg

SEQ ID NO: 1251 - DNA, 619 bp, Homo sapiens
gtccgcgggcgatgctgctgcggagggtggtcgagggaggccgggcggtagccgccgcggtccgtggctcgggggctcgccggttctccagcccggactgctgccagaggcttcctggaggtggcagctttcttcaaaggcaccatcccggagcgcaagcccctgatgggcgcagaaaattcgggacagaccacgtagaggtgggctcccaagcaggtgcggacggcaccaggccgcccaaggcatcgctgccacctgagctccagccgcccacaaactgctgcatgagtggctgccccaactgcgtgtgggtggagtacgcggacaggctgctgcagcacttccaggacggtggggagcgggccctggctgccctggaggagcacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttcacagg

SEQ ID NO: 1252 - DNA, 2027 bp, Homo sapiens
gtactgatgcatcatagttgacttccaccagtgttttaattgtttcatggttgcagatataaagggcaatgaacaaattgaaaaatattcttggagagaagcttgtgatactggcagctcaagaatggacagaaagcatggaaaatacatattgaacgttgagcactctgaaaaccagccgccaatcacacatccaaatgaccaagaggctcacagttccatatgctggtgtctaccttcaaatgatataaccagtgatgtctctcccaacttaactggggtctgcgtgaacccaggaatccttgcacattcaagatgtctacagtcagaatcctgtaacacacaggtaaaagaatattgccgcaatgactggtctatgtggaaagtcttcctggcttgtctcttagcctgtgtgataatgacagcaattggagtacttataatatgcttggtgaataacaaaggatcggccaattcctccattgttatccagctatccacaaatgatggagagtgtgtgactgtcaaacctggaacaccctctcctgcttgtccacctacaatgaccaccacttcaactgtacctgcaagtacagccactgaatctacaacttcaacagctacagctgccaccacttccacagaacctataactgttgcacctaccgatcatttataatttgaacagccatagccatcacttcaactgaaacttcaacctctaccacttcaactcagtttgcaactataatagctactcctatcacttcaagtggaatcatggctgcagtcactttaacagactctataaccgttacaacttcaacaaaatcaagtcctacttcaacttaaacttacttgacaactcaaataatcaccacttcgaccatctctttgactgaatcaacaactacattcccttcaactgaatctgcaaccacttccacttaacctataactactgtaacttctacttagcctacagtaacaatgctcatcactcttttccaacaatgtataatctccacctattcatctgaggactaagctctgatttttcatcttgcccaaattcctttctaaggggtatggggagtcatgccctacaaaccataaattctcatcagatgggttttatttaaccctgtatattgtgacttactttctaatctgactctggcataacaagggaaaaaaatcaaaatgttttaccccaaaatatatttccttgccataccttgaaattgtcctgcaaagtctcttgtggagaaactccacattctgtagagaatatcctttcccctttgttttccttcctttctttccagatccaggagataatcaactaagagccaggcacccttttaggtctaataagaaacactttacaacctgctctctctctgaagtctgctttctgagagattcctctgcacaataaaacttgatctccacaatcctttatcttaacctgaacattcctttccatggatctcaggtcttcagataaactaaaccaattgtcaaccagaacatgtttaaatttacctatagcctggaagccccaactttgagttgtcctgcctttctgaaccaagccaatgtatttcttaaatgtatttgattgatgtctcatgtctccctaaaaatatataaaaccaaactgtaccttagccactttggacacatgttctcaggacctcctgagggctatgtcatgagccatggtcactcatatttggctcagaattaatctcttaaaatattttacagagtttgactctttttgtcaacacatccgaacctgcaactacaaatgccaccattaccacttaaaacttgatagaactagcatcagtcatcaaaataacctgttctatattaagttaacttttagttatcaccagtaatactagcctacaactactcgccacactggctcttccccaaaattgaaattgtacaatatgtgagtctaattcttgctaacataacattattgcctacattaaaagcttctgcaaagc

SEQ ID NO: 1253 - DNA, 1369 bp, Homo sapiens
gcaccagctctgtgtcctcagagtcgctgtcatcaaggagacctctcactggtcaccgccgcagcccccacatggaccagtatgtgtccacagctcctccccgattccctatagcacagctgggaacatttaaacaagactctgcaggaatgggacggatattcaaggggaatttgctgcagaagaaagcacttaccacatttgaaaatgaacaccatattcgtttcttcacattgttggttcttttccatgtgatggtgttgctgaggaatcatagcaggatacaaggggtttctgaagactggaaaagggccaacagcatatttcgaaactttctacgtttgaagtcatccaggaacacagcagaagcagaataaatgacactacgtttctctctcatggccttcataccatggatttcccctgctcaagatgaaaagaaattaagaggaaatcagattgcttagagatagcagattattgctcactttttaaaaggagctccacagagagaatgaagaacgtgtaactttttgcaatgataatgtctgctttgttcttgaggggcactcttcctttttctgttcaggaatattccggaggagagctgcagatgccacccaaccctgcgaaatctgccctgcgtgtcgaaacagatccagcagtgcaaagaacttcttcattaggacatcaagcctgtagtcatattttcaattgctgctgtaactttttccttgcaagtgctttcacttatttcgggaccacctaaggctctgtgtggtatacagcaacacagtttgagatatttctgtgatgttctgtatatcatatagttgctaacaacctgtcaaagtcatcctgacaccaaactgagaagctgatggtttgggtaacatattagaggagatgaaaaaaccgacagtcctcattactgtaataaaaccagcagagacacactgagaatcaattactgattgtgacctaatgaactaaccctcagtcaagtagaaaactgcaccaagcctcttacattatcaaatgatttaggatggagcactgtctgaagacgggcaacaagtcgaggcagatgagttttcttatattgtggctgacttaattaccttgttcctgagtgcagagatcaaattgagcaacttaaggtgctaaagctctgtgccagctggaaatgaaaaggaaataattaacaccaacaagagctacgtctaaggttgtggcacctcctgacagaagcaaggagactcaaagttaaggcggctgcaaagtccttgacgaggtgagccctgctctatccgcctggctggattcgtccaggttgcctgtggcagctgtgcactgaagagtccggctg

SEQ ID NO: 1254 - DNA, 1834 bp, Homo sapiens
aatacccagatcttcaaggttggcaaagaagagaaaagctccttgggaacttagttaccaggtcttatagcaccagctctgtgtcctcagagtcgctgtcatcaaggagacctctcactggtcaccgccgcagcccccacatggaccagtatgtgtccacagctcctccccgattccctatagcacagctgggaacatttaaacaagactctgcaggaatgggacggatattcaaggggaatttgctgcagaagaaagcacttaccacatttgaaaatgaacaccatattcgtttcttcacattgttggttcttttccatgtgatggtgttgctgaggaatcatagcaggatacaaggggtttctgaagactggaaaagggccaacagcatatttcgaaactttctacgtttgaagtcatccaggaacacagcagaagcagaataaatgacactacgtttctctctcatggccttcataccatggatttcccctgctcaagatgaaaagaaattaagaggaaatcagattgcttagagatagcagattattgctcactttttaaaaggagctccacagagagaatgaagaacgtgtaactttttgcaatgataatgtctgctttgttcttgaggggcactcttcctttttctgttcaggaatattccggaggagagctgcagatgccacccaaccctgcgaaatctgccctgcgtgtcgaaacagatccagcagtgcaaagaacttcttcattaggacatcaagcctgtagtcatattttcaattgctgctgtaactttttccttgcaagtgctttcacttatttcgggaccacctaaggctctgtgtggtatacagcaacacagtttgagatatttctgtgatgttctgtatatcatatagttgctaacaacctgtcaaagtcatcctgacaccaaactgagaagctgatggtttgggtaacatattagaggagatgaaaaaaccgacagtcctcattactgtaataaaaccagcagagacacactgagaatcaattactgattgtgacctaatgaactaaccctcagtcaagtagaaaactgcaccaagcctcttacattatcaaatgatttaggatggagcactgtctgaagacgggcaacaagtcgaggcagatgagttttcttatattgtggctgacttaattaccttgttcctgagtgcagagatcaaattgagcaacttaaggtgctaaagctctgtgccagctggaaatgaaaaggaaataattaacaccaacaagagctacgtctaaggttgtggcacctcctgacagaagcaaggagactcaaagttaaggcggctgcaaagtccttgacgaggtgagccctgctctatccgcctggctggattcgtccaggttgcctgtggcagctgtgcactgaagagtccggctggggagccagggattcagaactcacagtgcagcctgacgaccaaagggcaaatccacctgaggacctgagtgcagatggctgggctccccggaacaaagtggaggaatgacagaggtgtaactcttacaccacagcctccatctgtgtgtcgcagagaaaaatactataatggagactattcttacacacatacacacacacacacacacacagagttcttgtcaccgatggaacagtctgtctttgtctttcatctcccacattcatgtccagatcccattgcgctgcatcacacgtgaacccagtgaggtcaacaatgaatggatggtgttcacaaagaaaccagcttatggaaggggacctgttacaattctttgaattaagttcttggaagcc

SEQ ID NO: 1255 - DNA, 915 bp, Homo sapiens
ggagtagaacttcttgattcctcagataaatagaggacagatgctggactgtagctaagtatttcctttcatctacgggataaaatactgataatttgagagtgatggacaaggttcagagtggtttcctcattttgtttttgtttttaatggaatgccaacttcatttatgcttgccgtatgcagatggactccatcccactggaaacataacaggcttaccaggcagtaaacggtcacaaccacccagaaacatcaccaaagagcccaaagtgttctttcataaaacccagttgcctgggattcaaggggctgcctcgagatccacggctgcatcccctacgaaccccatgaaattcctgaggaataaagcaataattcggcatagacctgctcttgttaaagtaattttaatttcgagcgtagccttcagcattgccctgatatgtgggatggcaatctcctatatgatatatcgactggcacaggctgaggaaagacaacagctcgagtcactttataagaacctcaggataccgttattaggagatgaagaagagggctcagaggacgagggtgagtccacgcacctacttccagagaacgaaaatgagctggaaaagttcatccactcagttattatatcaaaaagaagcaaaaatattaagaagaaactgaaggaagagcaaaactcagtaacagaaaacaaaacaaagaatgcgtcacataatggaaaaatggaagacttgtgaacgcagacgacagaggtgccggctgaggcagaggagaaactatgggggtgctgggagactgagcctgtgggcgtggcttgctcccagagaaccttatggaagaggacatcaaagaaagaaatgccagacctgtatcccagaaaataaagccacatgatatagc

SEQ ID NO: 1256 - DNA, 2453 bp, Homo sapiens
gcgcagcgggggcggcgggccggggaccgggcagcaccgggcgcgcggagcgggcgcgccgccaacgcggtcacgtgcgcggcccctcctctcgcgccggcctcccccgcgccgcgctctccattcataaattctccgcctgctccgcggccaccgggcgccggagccagccgcgagcgccacgcagccgcccgccgccagcccgccgcccatgggccgctcgtcccggcgctgagggccctcctccccagttcagaatgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagaccccgacttccggggagaggaccccgagtgccaggatgcggagaccgaacgcttcctgtccaccagctccacgggccgccgggtctccttcaatgaggcggcgctgtttgagcagagccgcaagacgcaggacaagggccggcagggtggatggcagagcacggcagctggggcatcgggcatgggaggtgggcgggctctgatggccagatgctgtcgcaggtacacactgacggagggggacttccaccacctgaagaatgcccggctcacgcacctgcacctgccgcccctcaagattgtcaccatccacgagtgtgactcaggcgaggccagctcagccaccacgccccacccggccacctctcccaaggccactctggccatcttccagcccccggggaaggccctcaccggccgctctgtgggccccagctccgccctgccaggtgacccctacaactcagccgcgggcgccactgacttcgcagagatcagcccctcggcatctagcgactctggggaaggcacctcgttggatgccggtaccaggagcaccaaggctggagggcccggggctgcagcagggcctggggaggcgggcccgggatccggggcaggtaccgttctgcagttcctcacccgcctgcgccgccatgccagcctggatggggccagcccctatttcaaggtcaagaagtggaagctggagcccagccagcgggcagccagtctggacacgagaggttcccccaagcggcaccacttccagcggcagcgggcagccagtgagagcacggagcaggaggagggggatgccccccaggaggacttcatccagtacattgcccgggcgggcgacgccgtggccttcccgcacccccgcccctttctggccagcccgccccctgctctcggcaggctagaggcggccgaggcagcgggaggagcgagccccgattcccccccggagcgcggcgcgggcagcgcggggcctgagcagcagcagccgccactggagccggacgccgagcgggacgcgggccccgagcaggcccagaccagctaccgcgacctgtggagcctgcgcgcctcgcttgagctgcatgcggccgcctcggaccacagcagcagcggcaacgaccgcgactcggtgcgcagcggcgacagctcgggctcaggctccgggggcgcggcgcccgccttcccgccgccctccccgcccgcgccgcggcccaaggacggcgaggcgcgccggctgctgcagatggacagtggctacgccagcatcgagggccgcggcgcaggcgacgacaccgagccacctgccgcgcccgcccggccccgcagcccgcgcgcctggccccgccgcccgcgccgcgactacagcatcgacgagaagacggacgcgctgttccacgagttcctgcgccacgacccgcacttcgacgacacgccggctgccgcgcgacaccgcgcccgcgcgcacccgcacgcccgcaaacagtggcagcgtggccggcagcacagcgaccccggcgcccgcgcggccccggccctggccggaaccccggcaccgcctgccggcgcggcccgacccgcgcgtgcgcccttgcggcgcggcgacagcgtggacggcccgcccgacggtcgcaccctgggcggcgccggcgacgaccccgccatccccgtcatcgaggaggagccgggcggcggggggtgccccggctcgggcctgtgcgtcctaccatccgggtcggtgctggacaagctggcggctggcctcgacgagagactctttccgccgcgcctcgccgagcccgtcgtggcgactcccgcgttggtcgccgccgcccccacgtcccccgaccacagcccggcctaa

SEQ ID NO: 1257 - DNA, 1089 bp, Homo sapiens
tggcctcacaggaggagttggcggggagccttgggcccctctggcctcagccggatttcccagccaaacgcagagagagatgccctggaccatcttgctctttgcagctggctccttggcgatcccagcaccatccatccggctggtgcccccgtacccaagcagccaagaggaccccatccacatcgcatgcatggcccctgggaacttcccgggggcgaatttcacactgtatcgaggggggcaggtggtccagctcctgcaggcccccacggaccagcgcggggtgacatttaacctgagcggcggcagcagcaaggctccagggggacccttccactgccagtatggagtgttaggtgagctcaaccagtcccagctgtcagacctcagcgagcccgtgaacgtctccttcccagtgcccacttggatcttggtgctctccctgagcctggctggtgccctcttcctccttgctgggctggtggctgttgccctggtggtcagaaaagttaaactcagaaatttacagaagaaaagagatcgagaatcctgctgggcccagattaacttcgacagcacagacatgtccttcgataactccctgtttaccgtctccgcgaaaacgatgccagaagaagacccggccaccttggatgatcactcaggcaccactgccacccccagcaactccaggacccggaagaggcccacttccacgtcctcctcgcctgagacccccgaattcagcactttccgggcctgccagtgaggctgaggactgggggacccctctgtctccaggcattcgggggcctgaggtccctccagctacttctgggggggctctgtcagccactttctcagggaattggacagaggaaaggaaggggaaccctggccttgggattttcatcacagaggagtgggagaggggacacaggcatgggcctggcactatacagacaacaggaagttcccctctcgaccttcggctcctcaggaccaccagagaaggagatgtcaggaccccttcttgtcccccagctgggccataagacgtcccaggtctctgcacacccgtggaat

SEQ ID NO: 1258 - DNA, 1354 bp, Homo sapiens
ctgcagcctcaggcccgggtgactccagcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttcctacgaggacccagctgggggcaaacactgtgagcaccccatttctggcctggaggtactagaggctgagcagaacagcctgcacctgtgcctgctggggctgggccgccggctgcaggacctggagcaaggcctggggcactgggcattggcccagagtgggatggtgcagctgcaggccctccaggtggacctacgaggggcagctgagcgtgtggaggcgctgctagcgtttggtgaggggctggcacagcggagtgagcccagggcctgggcagccctggagcagatcctgcgggccctgggagcttaccgagactccatcttccggcggctctggcagctgcaggcccagctggtcagctacagcctggtgttcgaggaggccaacacgctggaccaggacttggaggtcgagggagactcggactggccaggacctggtggggtctgggggccctgggcacccagtagcctccccacttccacagagttggagtgggatccggcgggggacattgggggccttgggcccttgggacaaaagacagcccggacactaggagtgccctgtgagctgtgtggccagagggggccccagggcaggggacaaggccttgaggaagcagacacctctcactcccgacaggacatgctggagtctggcctcggccaccagaaacgcttagcacgtcaccaaagacactccctgctccggaagcctcaggacaagaagaggcaagcatctcctcatctccaggatgtgaggctggaggggaatccaggggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaa

SEQ ID NO: 1259 - DNA, 1004 bp, Homo sapiens
ggcccgggtgactccagcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttcctacgaggacccagctgggggcaaacactgtgaggtgttcgaggaggccaacacgctggaccaggacttggaggtcgagggagactcggactggccaggacctggtggggtctgggggccctgggcacccagtagcctccccacttccacagagttggagtgggatccggcgggggacattgggggccttgggcccttgggacaaaagacagcccggacactaggagtgccctgtgagctgtgtggccagagggggccccagggcaggggacaaggccttgaggaagcagacacctctcactcccgacaggacatgctggagtctggcctcggccaccagaaacgcttagcacgtcaccaaagacactccctgctccggaagcctcaggacaagaagaggcaagcatctcctcatctccaggatgtgaggctggaggggaatccaggggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaa

SEQ ID NO: 1260 - DNA, 1308 bp, Homo sapiens
tggacaaatttgcgggctggggaccatggaagtggaggaaatctacaagcaccaggaagtcaagatgcaagcaccagccttcagggacaagaaacagggggtctcagccaagaatcaaggtgcccatgacccagactatgagaatatcaccttggccttcaaaaatcaggaccatgcaaagggtggtcattcacgacccacgagccaagtcccagcccagtgcaggccgccctcagactccacccaggtcccctgctggttgtacagagccatcctgagcctgtacatcctcctggccctggcctttgtcctctgcatcatcctgtcagccttcatcatggtgaagaatgctgagatgtccaaggagctgctgggctttaaaagggagctttggaatgtctcaaactccgtacaagcatgcgaagagagacagaagagaggctgggattccgttcagcagagcatcaccatggtcaggagcaagattgatagattagagacgacattagcaggcataaaaaacattgacacaaaggtacagaaaatcttggaggtgctgcagaaaatgccacagtcctcacctcaataaatgagaggacattgtggcagccaaagccacaacttggaagatggggctgcacctgccaacgaagacgggaaatgaccccccccccccagcctagtgtgaacctgcccctcgtcccacgtatagaaaaacctcgagtcatggtgaatgagtgtctcggagttgctcgtgtgtgtgtacacctgcgtgcgtgtgtgtgcgtgtgtgcgcgtgtgttcgtgtatgtgcgtgtgtgcgtgcgcgtgtgtgtgcattttgcaaagggtggacatttcagtgtatctcccagaaaggtgatgaatgaataggactgagagtcacagtgaatgtggcatgcatgcctgtgtcatgtgacatatgtgagtctcggcatgtcacggtgggtggctgtgtctgagcacctccagcagatgtcactctgagtgtgggtgttggtgacatgcattgcacgggcctgtctccctgtttgtgtaaacatactagagtatactgcggcgtgttttctgtctacccatgtcatggtgggggagatttatctccgtacatgtgggtgtcgccatgtgtgccctgtcactatctgtggctgggtgaacggctgtgtcattatgagtgtgccgagttatgccaccctgtgtgctcagggcacatgcacacagacatttatctctgcactcacattttgtgacttatgaagataaataaagtcaagggaaaacagcgtc

SEQ ID NO: 1261 - DNA, 900 bp, Homo sapiens
aaatccgggcccttggtcccccgcgcgggcgcgggtggatctctcgggctctgacttgttttcgggtcaccttcaggcttcagccaggcacctgacgcctctttcccctcacggtgccagggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtg

SEQ ID NO: 1262 - DNA, 1706 bp, Homo sapiens
agataatgttaacaatgtgatttagagtggaagcaataccagatagtctaacaatgtgatttagaataggggctttggatcaaatggtatcagctcaacttcaggaggagctggatgctaagatccaccatgagggaagtcaccatgttacacgatggaggcccaataaaaacactggacacaaggcttgggtgaacaggccttcacgatgaccagagacagaagcccctgacttggctaaagatacttctgctctccccatccccacatcctctttcagttacgcatcacctcactccttctgaaccatatggttctgatgtcagagccagtgtagtaaagagcttctgctgttcctgagaactgttgctgctggaagtgatgcttccactgctacagctggtacctgctaagctgctcaactcctcttgctccttggagaagacactgcagtgcagctgttccttccatgggattcccacaccctctgtgcagtggtggatgggaggagtccccgtgggtgtggatggcatggatggcagcctccaagtgacttccaccatgcttggcccctgggctaacagcaccatcagcctaactgaagagccagaaatgggcatgagacttctctgtgaggggaagaaccaaaacggaacccatgctttgagcatcctactgatgtcaagaaagagttctttggctgcccaggccttcgtgaaagggctgatccagggtgctatctatgcgggaattgtaattgcgctgctcttcctctgcctcctccctctcatagtgaaacatatcagaaagaagcaggcgaagaaagctgcagcgatcagagcaaaaaagagctctaaagtcagagcaagccaagaacttgagatgtctctgaagcctgaggaaccaggaaaacccgtagtcgccacattttctgagagccggatattggaaaagcaagataaacgagccagctaagcctgtggaacatgcctcatacctggagtcgccattatccctggaattacaaagatctgcaaaatttatagcgctcacagaaaccctggaggctgtaataaacctggagccccctggactctcctcagctcacaaaaccctctcaattcctacacatcccttaacactcattctccattgaataggtggttactcttagacctagtcttagaacctctgaagacacactttgtaatttgttgtttggctaaatgagaagaaatctgtgccaccctgggaaggtgtcaaaagaaggaaaaatacatgtgacaatatgaatcaagtccatcagcaagttacttttgagcgcctactgtgtgtcagtgcctgagatacacctacaagagcgccaggctttcaagccttcatatctggatagaatcccaacttcagtgcttggtggctgtctatctttggacaagatctttcattccccatcctttgaacatcacatgacccatatctgggtggagaatgggtgaaaagtactgttcagagatgcaggtgagaaaaaacatgacgatgggccctgaatgccaagattcattggagctttggagctttatcttgtaggaccttatcctgactcccttagaatgtaagttccaagagaacagggactttgtctgccttgttttctacttttatcaccagcacccagaatgatgcctaaaatacaataagatctcaag

SEQ ID NO: 1263 - DNA, 908 bp, Homo sapiens
ggcagggcctcgcccacaccaaacctgtggacgccgacccgggaccgccgctggctggctgctggctcactcgaccgtcatggagaccctgggggcccttctggtgctggagtttctgctcctctccccggtggaggcccagcaggccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggccaaggagaaagaagagaagaggaagaaggagaaaaagacagcaaaggaaggagagagcaacttgggactggatctggaggaaaaagagcccggagaccatgagagagcaaagagcacagtcatgtgaagattcctggctgcctcttccaggcagtcccccagagatgcctcttctgccccctaaaagcagtgccctggacttgaagcccgtgaaatgactccatctgggattcagaatacagtgttctcaagtgaagaaggcttggaacccaccccacctccctcattgggggctctctgggcaaacatggttttcatgcacccctcttcctgagcttggtccctgcctggtgattcttcttatactcggagagcatccctggttgaggagacacccgcaatcctccacgatctcatggctccacctgcttctccccactgcctgatttcttttctctctgcctgatgtctactgaacagaacttcccctctcccatgcacccactgccagctgagagctgcttcccaatggcctgcattaaagcattcgtaacagccctttg

SEQ ID NO: 1264 - DNA, 3898 bp, Homo sapiens
aggagaccccgggtgacggggcccggcgccgctaactggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttctttttttttttttgagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagcttactgcagccttgaactcctgggatcaatcagtcctcctgcctcagcctcccgagtagctaagactaacaggtatgtaccaccatgcctggtttattgttttatttttttggcagagatgggtctcactgtgttgcccaggctgatctcaaactcctggcctcaagcgatcctcccatctcagcctcccaaagtgctgggattacagacctgagccaccacacctgggcaacagagtgaaacctgtccctgttttcctgctcttactctcacctctgaggcctcctctgcctggaagagattacagggaaattccaggcagcccttgtcaattgtttttatgaattctttacctgttccttttaaagacaaggaaactgaggcccaaagttctaagttgtttggcaaatggagtctcctaccctcagctcctgcaaggacctgggggacccccaggtccagcagccacatgattctgcagcagacagggacctagagcacatctggatctcagccccacccctggcaacctgcctgcctagagaactcccaagatgacagactaagtaggattctgccatttagaataattctggtatcctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtggggtctttgggatggatctcctagggctgggctggaagcctcatgtactgttgtcttctaggtaaccaccctgaagagaaggggtggcatcaggaaccgcagggaaccaagcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaggaaaattggcaattgtattaatccattctcgaattgctgtaaagaaatacctgagactgggtaatttaatttataaagaaaagaggtttaattggc

SEQ ID NO: 1265 - DNA, 1365 bp, Homo sapiens
ggagaccccgggtgacggggcccggcgccgctaactggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccagctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcata

SEQ ID NO: 1266 - DNA, 1240 bp, Homo sapiens
ggatggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacgacccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacacttttttctttt

SEQ ID NO: 1267 - DNA, 1059 bp, Homo sapiens
tggcgcctcacgacccgggtagtcttacgaccctggtgccctgggctgccgccctgctcctcgctctgggcgtggaaagggctctggcgctacccgaggtacagaagcaagtttgaggtcgggctgaagcagggtcgctggccagccgtgcgtcgcgctcgccagcggctcccccttctcctcggcgggcctgcggttctgatttcgtccctgacgcttcccgaccctgcccagccagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacacttttttctttttttttcctctctttctttttaa

SEQ ID NO: 1268 - DNA, 612 bp, Homo sapiens
gtcagattgagaagtctctgcagaaagcataataaataagttcgaatagtgatcttcagagatgaggaccttccctgtgcgatatctggtactgaaagtgtcgggagctgattcggcgcaggactctggaggaagagatggcatctcctagcctagcctgttacaagggtgggacacgagccgtttatccatttatcggccccgtgttagaggaattctggaaacgtgtactggcagttaattcttgatcgccgtttgttcttttcttggcttttctttctggagttctaatgtttctttctcttctgcagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaa

SEQ ID NO: 1269 - DNA, 1495 bp, Homo sapiens
agttcccagctgtccgaaaggtcttcggaacttcggctctaaagcgttcctcagcgccatccgcccggaaacacgagcgacagagaaaaggtccgcgaggccggcagactccagagtggctgggtccgagcgcggggcgggttgccgaagggcctcggcctgggctgcgtgctggagagcggggacggggccgactcaccagaggctgcagcaacaggtccactttgctctccagtctctttctccgacaccgctgaggcggtttcccaccgacttcctttccatacagcaccggcaggcaccggtgtgaagggtcataaaaatggcgctggccgctcgtttgctaccccagttcctgcactctcggtcgctgccctgcggggccgtccgactccggactcctgctgtggccgaggtgaggctgccgtcggccacactttgctacttctgccgctgtcgcctcggcttgggagcggcgttatttccacgaagcgctagggccttggcagcctcggcgctacctgcccagggctcccggtggccagtgctcagcagcccgggactccccgcagccttcgcttctttccctgcctgccctcagcgcagctacagcacggaggagaagccccagcagcaccagaaaaccaagatgatcgtcctgggattctccaaccccatcaactgggttaggactcgaattaaggccttccttatctgggcctatttcgacaaagagttcagcatcacagagttctccgagggagcgaagcaggcttttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattg

SEQ ID NO: 1270 - DNA, 1386 bp, Homo sapiens
cgagcgcggggcgggttgccgaagggcctcggcctgggctgcgtgctggagagcggggacggggccgactcaccagaggctgcagcaacaggtccactttgctctccagtctctttctccgacaccgctgaggcggtttcccaccgacttcctttccatacagcaccggcaggcaccggtgtgaagggtcataaaaatggcgctggccgctcgtttgctaccccagttcctgcactctcggtcgctgccctgcggggccgtccgactccggactcctgctgtggccgaggtgaggctgccgtcggccacactttgctacttctgccgctgtcgcctcggcttgggagcggcgttatttccacgaagcgctagggccttggcagcctcggcgctacctgcccagggctcccggtggccagtgctcagcagcccgggactccccgcagccttcgcttctttccctgcctgccctcagcgcagctacagcacggaggagaagccccagcagcaccagaaaaccaagatgatcgtcctgggattctccaaccccatcaactgggttaggactcgaattaaggccttccttatctgggcctatttcgacaaagagttcagcatcacagagttctccgagggagcgaagcaggcttttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaactacttacaaa

SEQ ID NO: 1271 - DNA, 2176 bp, Homo sapiens
cccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaacgaa

SEQ ID NO: 1272 - DNA, 2543 bp, Homo sapiens
gggcccggagcttcctccgcggggcccccaggcccgagggccgggctgctgatccgccaggcacggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggagattactattctgacttctcagcctggaaaagaggtggtcaaacagttggaggaagggttgaaagatacagacctagccagagtcaggaggtttcaggtcgttgaggtcacaaagggaatcctagagcacgtggactcagcgtctcctgttgaggataccagcaatgatgagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaatgtgtctgaaatgtgatctccaagagcgactgctctgcccatccctactcgctggcacagctgacggctccttgagaatggatgaccctaaaggagacttcatcacactctaccagatggcttcccagtcatcggcctctcattacaagctccaagtgatcaaggctttaaaatctagcgggctctgcgagtcattgacatatggactcccgttcatcctcagacctacaagctgttggcagctggactgggatgagctggagacaaatcagcaacatttccatgctttgtgtcacagcctgctgaaaagggaatggctgctgttagccaagggggaaccaccgggcccaggacacagccagagaattcctgccagcaccttctatgtgatcatgccgtcacactccctcacactgctggtaaaggcggtggccacgcgggaactgatgctgcccagcaccttccccctgctacctgaggacccacatgatgatagccttaagaatgtggagagcatgctggacagcctggagctggagcccacctacaaccccttgcatgttcaaagccacctgtactcacacctgagcagcatctatgccaagcctcaggggcggctccacccacactgggagagccgagctccgagaaagcatccctgcaagactgggcagttgcagaccaaccgagctcgagctactgtggcccccctgcctatgactcctgtcccaggcagagcctccaagatgccagcagccagcaaatcttcctcagatgccttcttcctgccttcagagtgggagaaggatccctcaaggccctaagtcaccagcaccagagcccagctgcccagcttaaccatatccatgctcaggttcacataatggctatctgtggtcagacttgctctctatccgcctgagcctctgtgagtgagggctgactgggaaacaacagccttcctgtcctgtttcagtgctgtcccactcctcaagtctggaagcgacacacccgagcctgtcctttctccagcaaggactttcattttctttagaatcatttgctactgtttacacaggtgaagattaaacacccagtaagcttctaccattgttaggagcattcataactcagaatttcttcttgtagctctgtgtaagcaggtggatgaggtcagatcacctttggtaaactggacctcaggaacaaggatgaggttttgaaagctcataaaagacaagtaagattgaaatccaagcctcatttcagagcctgtgcccttcccactacaccaccaggcttcagcctccaaagagacaagtgcttggtacctacatgcaaagtgtgtgtgctggggggtgggagggctgcccagaacaggggagaggatggtgtaaaaaaagacctactcctttcctgttaccctctccccacatgtaccaaccttcctgttgctccctccatccacagaataatagctaccatttataaaatgtttactctgggctgggagcagtggctcacacctgtaatcccaacactttgagaggctgaggtgggatgatcacttgaggccaggagttcgagaccagcctgagcaacactgtgagacccccccgccatctctacataaataataaaaacttttaaaaaaaca

SEQ ID NO: 1273 - DNA, 1503 bp, Homo sapiens
gggcccggagcttcctccgcggggcccccaggcccgagggccgggctgctgatccgccaggcacggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggagattactattctgacttctcagcctggaaaagaggtggtcaaacagttggaggaagggttgaaagatacagacctagccagagtcaggaggtttcaggtcgttgaggtcacaaagggaatcctagagcacgtggactcagcgtctcctgttgaggataccagcaatgatgagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaatgtgtctgaaatgtgatctccaagagcgactgctctgcccatccctactcgctggcacagctgacggctccttgagaatggatgaccctaaaggagacttcatcacactctaccagatggcttcccagtcatcggcctctcattacaagctccaagtgatcaaggctttaaaatctagcgggctctgcgagtcattgacatatggactcccgttcatcctcagacctacaagctgttggcagctggactgggatgagctggagacaaatcagcaacatttccatgctttgtgtcacagcctgctgagcatgctggacagcctggagctggagcccacctacaaccccttgcatgttcaaagccacctgtactcacacctgagcagcatctatgccaagcctcaggggcggctccacccacactgggagagccgagctccgagaaagcatccctgcaagactgggcagttgcagaccaaccgagctcgagctactgtggcccccctgcctatgactcctgtcccaggcagagcctccaagatgccagcagccagcaaatcttcctcagatgccttcttcctgccttcagagtgggagaaggatccctcaaggccctaa

SEQ ID NO: 1274 - DNA, 544 bp, Homo sapiens
gaacgcgcgggcgcacgctgagagccgggaggaccaggtgagggggcctccgtcttccgaagacaggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggag

SEQ ID NO: 1275 - DNA, 2077 bp, Homo sapiens
gaacgcgcgggcgcacgctgagagccgggaggaccaggtgagggggcctccgtcttccgaagacaggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggagattactattctgacttctcagcctggaaaagaggtggtcaaacagttggaggaagggttgaaagatacagacctagccagagtcaggaggtttcaggtcgttgaggtcacaaagggaatcctagagcacgtggactcagcgtctcctgttgaggataccagcaatgatgagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaatgtgtctgaaatgtgatctccaagagcgactgctctgcccatccctactcgctggcacagctgacggctccttgagaatggatgaccctaaaggagacttcatcacactctaccagatggcttcccagtcatcggcctctcattacaagctccaagtgatcaaggctttaaaatctagcgggctctgcgagtcattgacatatggactcccgttcatcctcagacctacaagctgttggcagctggactgggatgagctggagacaaatcagcaacatttccatgctttgtgtcacagcctgctgaaaagggaatggctgctgttagccaagggggaaccaccgggcccaggacacagccagagaattcctgccagcaccttctatgtgatcatgccgtcacactccctcacactgctggtaaaggcggtggccacgcgggaactgatgctgcccagcaccttccccctgctacctgaggacccacatgatgatagccttaagaatgtggagagcatgctggacagcctggagctggagcccacctacaaccccttgcatgttcaaagccacctgtactcacacctgagcagcatctatgccaagcctcaggggcggctccacccacactgggagagccgagctccgagaaagactgggcagttgcagaccaaccgagctcgagctactgtggcccccctgcctatgactcctgtcccaggcagagcctccaagatgccagcagccagcaaatcttcctcagatgccttcttcctgccttcagagtgggagaaggatccctcaaggccctaagtcaccagcaccagagcccagctgcccagcttaaccatatccatgctcaggttcacataatggctatctgtggtcagacttgctctctatccgcctgagcctctgtgagtgagggctgactgggaaacaacagccttcctgtcctgtttcagtgctgtcccactcctcaagtctggaagcgacacacccgagcctgtcctttctccagcaaggactttcattttctttagaatcatttgctactgtttacacaggtgaagattaaacacccagtaagcttctaccattgttaggagcattcataactcagaatttcttcttgtagctctgtgtaagcaggtggatgaggtcagatcacctttggtaaactggacctca

SEQ ID NO: 1276 - DNA, 1921 bp, Homo sapiens
tcttcccaggaggctcctcgctgcctggtgccgtagaggcccatggaggaaaaggaagataagcatcaacagcataaaatagaggatgctgctataacatatgtaagtgaaaatgaagaaattaaacacgaagaaaaacctggaaaaagcatacatcattcaaaatcacatgttggaagaggacgtatatattatgctaaattcattaacacaaatgcaagaacatacaatgaaccatttccctacatagatcccaaaaaagggccagaaatacagggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcctgagagcagagaaaagacctcaggcgccactcaaacaactgtaggagatgctcttttcactaggcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtggtctccaataagtggagtgagacattatttctatgtcacattctttatgaacacaactttgttttgcacaacacatgatcgtaattaacaaatataatacttttagaagagaggccctgttagacatgagtggacagctttggaatcaaacaaactagagttggaatgttggcttcacttcattccttgagctgtgtgaccttgggtaagtaacttaacctctctagacttcagttttctcaactgtaaaattaggaaaatagcaacttcgtaagattattgaggatgtgattatgcacattgatcagtaagtggtcaatgtaatcatatcatcactgctactataattcaattttcaatttaaggataatgttctcttatatatttaatttttcctcattattctaaaacttagaactcctccatatataattaaaagtgtgaaaatctaaaaatacttctgccagtacaagatgcacagacacatacacacttaattcaaagacatatgggtacttagaatattgaagtattttctaaattgttttctattttactcagatcatttctagcaccaactcaacctttgctttttggatgagtttggtaaggattaattctacttccaatttggtgtgtttggtgtgccaaaatgtatctattataagatatgttatattgcatacaagtggaagtaggtggagtattcctctgttataaagagtatttacaaatttccattgggaaatatcagctgctcactattatctgcagtattgataagactacagctatatctttatccatttattctccattaaagaaattgtgataaactgc

SEQ ID NO: 1277 - DNA, 465 bp, Homo sapiens
gttaaccagcgcagtcctccgtgcgtcccgcccgccgctgccctcactcccggccaggatggcatcctgtctggccctgcgcatggcgctgctgctggtctccggggttctggcccctgcggtgctcacagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggc

SEQ ID NO: 1278 - DNA, 663 bp, Homo sapiens
gagccaggcccagcctggaaatggatgtcataagtgcacaggggtctagggaggcagagagcgaaagaggaaacaggagcgttttaggaaagactagagctgcctgagggtttggatcaaaactgctttaaaagtccttcttcaacaagcactgagcacctactccgggccaggcatggagaacccagagttaaccagcgcagtcctccgtgcgtcccgcccgccgctgccctcactcccggccaggatggcatcctgtctggccctgcgcatggcgctgctgctggtctccggggttctggcccctgcggtgctcacagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggctgcactcct

SEQ ID NO: 1279 - DNA, 561 bp, Homo sapiens
tcctaagtcagactttgtgcttgctctccctaggaatgctgatacctgattctagttatggatatggaggcaaggagaagttgttaggttaaccagcgcagtcctccgtgcgtcccgcccgccgctgccctcactcccggccaggatggcatcctgtctggccctgcgcatggcgctgctgctggtctccggggttctggcccctgcggtgctcacagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggctgcactcct

SEQ ID NO: 1280 - DNA, 1844 bp, Homo sapiens
ctccgctgccgcctaggcgcggggctgacctgcgggggtggggtggggggagggaggtcgaggcccggccccacgtggccgctgctgccgggctcaccccagccccgcccggaggcgccccgcggccccggctagccagggcgggcggccacctctgccctactccttccctccgcgttccgggcctcggagccgccttgaggaggatgagtccctggagctggttcctgctgcagaccctctgcctcctgcccacgggcgcagcttcgcggcgcggggcgcccggcaccgccaactgcgagctcaagccccaacaaagcgagctgaattccttcttgtggaccattaagcgagacccaccatcttacttctttggcacaatccatgtcccgtacacccgagtttgggacttcatccccgacaactctaaggaggctttcctgcagagcagcattgtgtactttgagttggatctcacagacccctataccatctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggttcccaattttattaatgccacgctaccacctcaggagcgcatcactgctcaggagattgacagctacttacgccgggagctgatctacaagcggaatgagagaatagggaagcgggtgaaggcccttttggaggagttccctgacaaaggcttcttctttgcctttggagctggtcatttcatgggcaacaacacagtgctggatgttttgcggcgtgaaggctatgaggtagaacacgcccctgctggacgacccatccacaaagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaacgactggaagcaccaggctaagaacctgacccctcggacttgaagaatggccattcctgtactccacattctggtctagccttgttgggcccaatccagaagagactgctcttgaaaaagcggcccagtgttgattcttctctttccaaggaatgtgactttgggttatccaactttgggggcaggtgtacagttttgtaacatagtgagttgtgtgaaaataaattataaatgagttgtatgaaaataaatacctttttttgtata

SEQ ID NO: 1281 - DNA, 1809 bp, Homo sapiens
tccttccctccgcgttccgggcctcggagccgccttgaggaggatgagtccctggagctggttcctgctgcagaccctctgcctcctgcccacgggcgcagcttcgcggcgcggggcgcccggcaccgccaactgcgagctcaagccccaacaaagcgagctgaattccttcttgtggaccattaagcgagacccaccatcttacttctttggcacaatccatgtcccgtacacccgagtttgggacttcatccccgacaactctaaggaggctttcctgcagagcagcattgtgtactttgagttggatctcacagacccctataccatctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcaggaaagcctgcgagcaggcagtcttcagatcccctacacgacggaggatctcatcaaacactataactgcggggacctcagctccgtcatcctcagccatgacagctcccaggttcccaattttattaatgccacgctaccacctcaggagcgcatcactgctcaggagattgacagctacttacgccgggagctgatctacaagcggaatgagagaatagggaagcgggtgaaggcccttttggaggagttccctgacaaaggcttcttctttgcctttggagctggtcatttcatgggcaacaacacagtgctggatgttttgcggcgtgaaggctatgaggtagaacacgcccctgctggacgacccatccacaaagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaacgactggaagcaccaggctaagaacctgacccctcggacttgaagaatggccattcctgtactccacattctggtctagccttgttgggcccaatccagaagagactgctcttgaaaaagcggcccagtgttgattcttctctttccaaggaatgtgactttgggttatccaactttgggggcaggtgtacagttttgtaacatagtgagttgtgtgaaaataaattataaatgagttgtatgaaaat

SEQ ID NO: 1282 - DNA, 2083 bp, Homo sapiens
aggattcactcactgcccacggccggctgagcagggacaggagaatgagaggcctccgctggcgttacactcggctgcccagccaggtggaggacaccctgtctggggaggagggtaacgaagaggaagaggaggaggaggcagctccagacccagctgctgctcctgaggatcccacggtgccccagctgacagaagccagccaggttttgagtgcctcagagattcggcagctcagctttcacttcccaccaagagtcaccggccatccctggagtctggtcttctgcacgtcaagggacggtttcagcctgcagagcctgtaccggcggatggagggctgcagcgggccagtgctgctggtgctcagggaccaggacgggcagatatttggagccttctcctcctcggctatccgactcagcaaaggcttctatggtactggcgagacattcctcttctccttctccccacagctgaaggtctttaagtggactggaagcaactctttctttgtgaagggagacttggattcactgatgatgggcagtggcagtggccggtttgggctgtggttggatggagacttgttccgcgggggaagctccccttgcccgaccttcaacaacgaggtgctggcccggcaggagcagttctgcatccaggagctggaggcttggcttctcagctgacagccctgcggcaacagaattctatgattgaagcctctaaatgaattgtgcaggagagggagtttgtaaacaactgactacagacattcacattgggtcatctttaaaaagctggactctgcttttggatgcttctcggaggcgagttggattttggactgaagtactgtcgttccattcctttttttgaggtgttatgagtggggctataacatcgccatcctattaggaagagagagaaaaacaggcaatagagaaaagccagtttccatcatcttatttctgagtgaaagtctcaagtgcgcacatcctcatcttgcatatagattgcttctagctgtcctcaatccagggaaactccaaattacatatgccctgtgcttggggcaaattagaaacactacagtcttacgcaggaagagccttcatgaaaacagccactggcctctgcagagatgactgggagcagcataccactgcccacctctatggcctccttcacacaccttcacggagcacaaactctgtcctgttttcccaggagaaagacgggatgcactgaacccctagcttctctctcgcctggtcccctctgcaataaaaggcccaggtctacaagatggcaaagaaggggaggaagaacagtatgtacctgcagaatttaaatttttctctgcatcaaagctctaacgttggtcccatcagcataggctccagccaaagaagctcctccacccaaaataagggagagatccaaagggaggcgatacaatgacgtgaaaccatagaggtaagaagcaaggcctcctaatacttgactctatgctaaactgttctgaacttgtgggtagatcttctttggttacaagatgatgcacgatcttggagagcctctgttgtaccaggaatacaatgctggtgggaggattcgtgctcctcatctgcttatttgctctcagatccattcttcactcttcctctccctactctgtctcacaggagctactccggtaaattacatttctcagctcccatgcctgttggtttccagttagatttggtcagtgggaggctctggtgggagactggaggtgagaagagggcagagaagtcaggttttttctctccctacctcctctggcacgagcggcagtggcagtgactattctgtggttctagcttttgcaggtggccccagctcctggactcccacctgctcccttggtctctcctatcctagaggtggtagcagcttcctgctgttgaatcactgtcctctatgctcatttagctctgccaaaacttttgtatctcacccccatgttaaattttttctgttgaactacactggatctgacttgatagaactattaaaaatagtttttaaaaaa

SEQ ID NO: 1283 - DNA, 2043 bp, Homo sapiens
gccatttggacagcatgccaggccacccaggagcagctgagcaacttgtcaagaccgggtggaggtcctggcacttggggttctggaaggcccttgccccactgcaggctgcctgggacgccttctcccagcctgttccagccagctgtggccagctgctgacccagctcctcctgtgtgcctccctggctgctgctgctgcaggtctggtttatcactggctggcatccttgctgctttatcctcctggaccttcagccatggttgccactgtctgtggcctcctggtcttcctgagcctgggcctggtacccccagtccgctgcctgtttgcactcagcgtgcccaccctgggtatggagcagggccgccggctgctcctgtcctacagcactgccaccctggccattgctgtggtgcccaacgtcctggccaacgtgggtgcggccgggcaggtgctgaggtgtgtcaccgagggctccctggagagtctcctcaataccactcaccagctgcatgcagcatccagggctctgggccccacaggccaggcaggcagccggggcctgacatttgaggcccaggacaatggctctgccttctaccttcacatgctcagggtcactcagcaggtcctggaggatttctctggcctggagtccctggcccgggcagcagcgctagggacccagcgagtggtcacagggctgtttatgttgggcctcctggtggagtcggcatggtacctccattgctacctgacagacctgcggtttgacaatatctacgccactcaacagctgacccagcggttggcacaggcccaggctacacacctcctggcccctccacccacctggctgctccaggcggctcagctgaggctgtcacaggaggagctgttgagttgtcttctaaggctggggctgcttgccctgctcctcgtggccacggctgtggcggtggccacagaccatgtagccttcctcctggcacaggctactgtggactgggctcagaagttgccaactgtgcccatcacgctcacggtcaagtatgatgtggcatacactgtcctgggcttcatccctttcctcttcaaccagctggctccggagagccccttcctctccgtccacagctcctaccaatgggagctccgcctcacctccgcccgctgcccactgctacccgcccggcgtccccgcgcagctgccccgctggccgcgggggccctgcagctcctggcgggctccacggtgctcctggaggcctacgcccgccgcctgcggcatgccatcgccgcttccttcttcacagcccaggaggcgaggagggtccgccacctgcacgcccggctccagcgaagacacgacaggcaccaaggccagcagctgcccctaggggatccttcttgcgtccccacacccagacctgcctgcaagcctccggcatggatagactacaggctggatgccttaagaaccgagagcagtgagggagaagggaaagagctttggagttgcagagacctgagttgtaaccttggtcctgtgccgcctccctgtgtgaccttgggtaagtcacttcacctctctgagcctcggtttctacatctgcataacgacagcatatttaccattgatgtgacctacttcccacgcagggatgtggtcaggatggaaggaaatactgggcatgataggcctggataaccggtaaagaaccatgcaaaggcgaagacaaggagtgcagagagagctcatggttcctccaggctggttggcgatcaggctcatctcatctgcaccaactgctctacttgttagatggagaccttgcatcatgaatttctcgaaatgctcctggaacttatttatatgcctcaaaatcctctaaactcatttatagtaacccatagttttaattttataaataaacgtatttattaaatcttagattacgttattcctctgcctcaaattccttcagggcctttccattgccaggattagattttgccaaattaaaatataggacact

SEQ ID NO: 1284 - DNA, 896 bp, Homo sapiens
ccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcagggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaa

SEQ ID NO: 1285 - DNA, 1114 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaa

SEQ ID NO: 1286 - DNA, 1059 bp, Homo sapiens
aggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtatgtgtagctgatagttttacaacaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaa

SEQ ID NO: 1287 - DNA, 2430 bp, Homo sapiens
tcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagtctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgacttctgctgattaaccttt

SEQ ID NO: 1288 - DNA, 1962 bp, Homo sapiens
gaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcg

SEQ ID NO: 1289 - DNA, 2117 bp, Homo sapiens
aggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagggaagctgcgctggttgtgatctgctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgacttctgctgattaaccttt

SEQ ID NO: 1290 - DNA, 1472 bp, Homo sapiens
ctgtttccggcacgccacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 1291 - DNA, 1562 bp, Homo sapiens
acttccggcgcactgatcccgcctggggccggctgagtggcacttaagcgggccatgccatgcaaccttgggcgctgccaaccgtgggcgagctctgggtgtgcgggcggcctggcgcggcgctccgatggagtctagttctgtcgcccaggctggagcccagtggtgtgatctcagctcactgcaatctccacctcctggcttcaagcgattcttctgcttcagcctcccgactgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 1292 - DNA, 306 bp, Homo sapiens
tctgaagacgggtaggagaataacgtatgtacaaagtacttagaacagctggcatctaacaaagactagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaaggg

SEQ ID NO: 1293 - DNA, 1536 bp, Homo sapiens
gtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtatgtacaaagtacttagaacagctggcatctaacaaagactagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 1294 - DNA, 1636 bp, Homo sapiens
ggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacggctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 1295 - DNA, 1660 bp, Homo sapiens
tggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacgtatgtagagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 1296 - DNA, 1735 bp, Homo sapiens
aagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacggatggagtctagttctgtcgcccaggctggagcccagtggtgtgatctcagctcactgcaatctccacctcctggcttcaagcgattcttctgcttcagcctcccgactgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 1297 - DNA, 1642 bp, Homo sapiens
aagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 1298 - DNA, 1781 bp, Homo sapiens
gttaagcgaagtgtggtggcttccaaggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaagttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 1299 - DNA, 1936 bp, Homo sapiens
ggatgaaagtacgggtcgcgagaggttgttcgcgccttgagagttaagcgaagtgtggtggcttccaaggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaagacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 1300 - DNA, 2336 bp, Homo sapiens
ggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 1301 - DNA, 1998 bp, Homo sapiens
gggcgaggctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtctt

SEQ ID NO: 1302 - DNA, 1033 bp, Homo sapiens
cgggtggcgcggagcacgagaaacaacgagtttctgtctagatcgtgggggacccaagcccggggttgcgtccaaggtcggggatggagaggacgcgacccccgcggcagtcgagatggcctttttaaaattctatatttgagaaggagtctcgcgctgtcgcccaggctggagcgcaatggcgcgaaatcggctcattgcagcctcgacgtccaggactcgagcgatcctcccgcctcagcctctcgagaagcagcacaaaacagagtaagacagtgacaaagatactcacctgtacaaaggaggaagcttcaaaagaagccattcatgtatggggtgggactgcagaaggaccacagtagagaatccctcaccaataaggaactgtgttaatcaggagtggccagaaggctcctctccaggcctcacagagggaaacactggtctagtgagagacctgcgtcctgcccatcaggaccgaagcggcacgcgtgaggatcctgcaggccaagagacaacagcgattacaaaccccagtcccagccttgcagctgaccttgcaggtgacgccctgcctgggtgtctcggtgcagctgcacatcaggggcctctgctggacagaagctctgagtccacacttggcccccaggcgctggagctggagcactgccacgagaggggatgctgccgtggctgcgccagcttcagccctttccctgcaccgagatgtcccagtgagcggctgggtgctcacagttcccgttgggccatcagaggaagatcaaagatcaaccctcccccatgggctcctgcctgcctgccaggtgggtttcctgcctgtctcccagcccccaagagctccacggactctgccagtagctgctttaaaggagggagggagttttctgatcctctggacatccctggggctggagctatgggctgagccataggagagccagcccagctccctgggggttgggggctgtgtctctccatcccttagtaaaaatacagcaactcccaactcaaa

SEQ ID NO: 1303 - DNA, 648 bp, Homo sapiens
gtcgcgggtgtagggtggcggcgctccgcctttcaccgacgcacctgggagaaacagaccggaggacgcgggtggcgcggagcacgagaaacaacgagtttctgtctagatcgtgggggacccaagcccggggttgcgtccaaggtcggggatggagaggacgcgacccccgcggcagtcgagatggcctttttaaaattctatatttgagaaggagtctcgcgctgtcgcccaggctggagcgcaatggcgcgaaatcggctcattgcagcctcgacgtccaggactcgagcgatcctcccgcctcagcctctcgagaagcagcacaaaacagagtaagacagtgacaaagatactcacctgtacaaaggaggaagcttcaaaagaagccattcatgtatggggtgggactgcagaaggaccacagtagagaatccctcaccaataaggaactgtgttaatcaggagtggccagaaggctcctctccaggcctcacagagggaaacactggtctagtgagagacctgcgtcctgcccatcaggaccgaagcggcacgcgtgaggatcctgcaggccaagagacaacagcgattacaaaccccagtcccagctgcacatcaggggcctctgctggacagaagctctga

SEQ ID NO: 1304 - DNA, 1247 bp, Homo sapiens
ccccaggcgtgggaagatggaaccagaacaattcgaacgagcagagcaaaacagatcggaattgcagacttcaggtcgtggcagagaaaaccagctgagacagggcgccacttactagctctgaaagtctaggatattttgccactggaagaccagcagacaatgtcatgacaactcaagaggatacaacagggctgcatcaaaagacaagtctttggaccatgtcaagacctggagcgaagaaggtaatgaactcctacttcatagcaggctgtgggccagcagtttgctactacgctgtctcttggttaaggcaaggtttcagtatcaacctgacttcttttggaaggatcccttggcctcacgctggagtgggcacctgccctagcccacagagctggatttctccctttcttcaatcacacagggagcaccactatgcaaagacctcatcacattcacagccgtctccgcagagcctcgcactgtgcttggcatatagcaggtgctcaataaatatctgccaaatgactgaatgcatctcgctagcctcaggatgccaccaggccctgagggagccaggaagatcagaggaaagcttttggattcctgccacaccttacattagcaacatcttctccgagtcctgacagccagcctcctgggacaccattcaagccagctgaattccggtcaccgcttcaccttggaaaggcatccgcagccctcaccaagcggccccgtaattgacgtcacagcggggccaggagctgccctgttaatatttaatgtggccttcactgcgcaaaatgcagcctctaagagctggaggggccgtgcagagtctccatggggttgtgaggagggcacagaagggaaagggctttataaaccataaagcgcccaacagatgagcattctgccgacccatttcagtccctggcttaactcagaaagagccggggctgcacatgcctgcagtgggacaagaagactgctgaccaagcccgaacactaaatcaatgggggattaggggctcctgggtacattccattgagacagcgggagagcagagcactggtgccagcccaacctggactccactccaggtttgccccctgcacagctgtgtgactgggtcagcaagtgcactgctgagcctcagtcccccttatctgtgaaatgggaatgatgctttccttgtagcactgctgtgaagattcaatgaaacgagtgatgccgaaga

SEQ ID NO: 1305 - DNA, 941 bp, Homo sapiens
aaagccgacacctattgagttgcagttaaaatgagggcgaaaaaggcttttgtttcagttctgcagatggtctgggagtttgtgtttcttagcaagaattttctagacgttttggcttgaaccatctgaaaaactgcctcaagcttttgcatggttcccactgggtgggctgggttgggaggggctgtcgtgcatggtccgggaaagctggagaaggctgttccttcaccccgagccttggatttcttatctgtgaaatgggaggctgcaatgatgaatggcaaagtacctttttttttcagctctgaaagtctaggatattttgccactggaagaccagcagacaatgtcatgacaactcaagaggatacaacagggctgcatcaaaagacaagtctttggaccatgtcaagacctggagcgaagaaggtaatgaactcctacttcatagcaggctgtgggccagcagtttgctactacgctgtctcttggttaaggcaaggtttcagtatcaacctgacttcttttggaaggatcccttggcctcacgctggagtgggcacctgccctagcccacagagctggatttctccctttcttcaatcacacagggagcaccactatgcaaagacctcatcacattcacagccgtctccgcagagcctcgcactgtgcttggcatatagcaggtgctcaataaatatctgccaaatgactgaatgcatctcgctagcctcaggatgccaccaggccctgagggagccaggaagatcagaggaaagcttttggattcctgccacaccttacattagcaacatcttctccgagtcctgacagccagcctcctgggacaccattcaagccagctgaattccggtcaccgcttcaccttggaaaggcatccgcagccctcaccaagcggccccgtaattgacgtcaca

SEQ ID NO: 1306 - DNA, 2273 bp, Homo sapiens
cggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 1307 - DNA, 2011 bp, Homo sapiens
actgggctggctgcggtggcgcgcgggcgcggcacccggaagtcggcggcggtggcggaggcgacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 1308 - DNA, 1559 bp, Homo sapiens
cggccccgcacctgcccgaacctctgcggcggcggtggcagggtacgcgggaccgctccctcccagccgacttacgagaacatcccccgaccatccagccccgagcagggactggcagagccggcgccccttccccggactctggccgcgtagcctccgccaccactcccagttcacagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttt

SEQ ID NO: 1309 - DNA, 931 bp, Homo sapiens
gacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttca

SEQ ID NO: 1310 - DNA, 585 bp, Homo sapiens
gaacctctgcggcggcggtggcagggtacgcgggaccgctccctcccagccgacttacgagaacatcccccgaccatccagccccgagcagggactggcagagccggcgccccttccccggactctggccgcgtagcctccgccaccactcccagttcacagctccatgcggacagctgtgaggcccccggagaaagccacagagagaaaatgctttcagctgggtgtcaagaacttttcaagagtggcagctgttgaaatcaaaagagtggccacagaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgag

SEQ ID NO: 1311 - DNA, 2085 bp, Homo sapiens
cggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcg

SEQ ID NO: 1312 - DNA, 862 bp, Homo sapiens
ctggccgactccgctagtggcccggccggcctgggctcgggggctccgggctctgggctctgggtgcgcggaccgggccaggctgcttgaaggtgggtgggctggccgcacttcctcaccctgcctcagtttcccctttctgagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctg

SEQ ID NO: 1313 - DNA, 883 bp, Homo sapiens
gacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcct

SEQ ID NO: 1314 - DNA, 1496 bp, Homo sapiens
gaacctctgcggcggcggtggcagggtacgcgggaccgctccctcccagccgacttacgagaacatcccccgaccatccagccccgagcagggactggcagagccggcgccccttccccggactctggccgcgtagcctccgccaccactcccagttcacagctccatgcggacagctgtgaggcccccggagaaagccacagagagaaaatgctttcagctgggtgtcaagaacttttcaagagtggcagctgttgaaatcaaaagagtggccacagaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaa

SEQ ID NO: 1315 - DNA, 570 bp, Homo sapiens
ggcacccggaagtcggcggcggtggcggaggcgacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaag

SEQ ID NO: 1316 - DNA, 2108 bp, Homo sapiens
atgcctctcggggcggggactccagtcaatgtacaaagacgtgaagactcagccacagaaggcagccacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcg

SEQ ID NO: 1317 - DNA, 1567 bp, Homo sapiens
gctttcttcccgagggcggcacgagggctgggcggtggggtgcgggtgcccgggtgaggggcggagctgggggcatggcgtccggagcggctcgctggctagtattggcacccgtcaggtccggggctctccggagcgggcctagcttgaggaaagatggcgatgtctccgccgcatggagcggctcaggccggagcctggtaccgtcgaggtcagtcatcgttacccgcagcggcgccattttgcccaaaccggtgaaaatgtccttcggccttctccgtgtgttctccattgtgatcccctttctctatgtcgggacactcattagcaagaactttgctgctctacttgaggaacatgacatttttgttccagaggatgatgatgatgatgactaacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgcgtgactgagtgatggctgcagtttctcagtatccctaggttctagttggtgcagttgtctctgctgtcctttatttatgggagaaacataggcccaggctatccaggctgcagtggagcctggtgaactattctgggggccctgggaactattttcattgtttacaaaagcccaacagaaactgtgcattttcccttaagaaagcttcatgggctaactaaagcctcatgccattctgtgttcagtgccagtcatgacagctctgcttgttagcatactacttaaatataactagaatgattcaaaactcgggttctgtgatatgaggatatagataggttttcatctatttcctggcttataactcccaaaacccttgttttaggcttttgttataatgttgggcacttcgggcctcagaaaacagcaggctgtttctcagatcttctcctgacctcctttcacctgctgctttttctccccaaggcaggccatagaaactaaaagtataatcttcctttgcccgtcttccagttggccataaaaagaatcctctgacctaccttgtctgattttaggtcatgagacccccatttcagaagggattctgccccatacctgagaggaagaaatgtagacaggccttgttggacttccccactccatctgtattagattatgcctcttttgtccaatcccatttctccagtgttgtccatgcttcaatcatccctatccaatgaggtctccataaaaggcccaagaagacaggtttagagagctttcggagaacagaacacttggctttgcaaagtggcacgcctggagagaacttggaagctccacgccccttctatacctcaccctatgcatctcttcagctgtatcttttgtgatatcctttataataaaccagtaaacgga

SEQ ID NO: 1318 - DNA, 4992 bp, Homo sapiens
aatatacagatgactgggtccttcccagtcccacgcgtttactcgatgaaggcagcctcccgccgggctcctggccccgcccgagccccaccccctgctcccttccggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactgg

SEQ ID NO: 1319 - DNA, 4672 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaaggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaa

SEQ ID NO: 1320 - DNA, 2168 bp, Homo sapiens
atgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaagtaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctcc

SEQ ID NO: 1321 - DNA, 3737 bp, Homo sapiens
atgccaaaagttttgtgcaaagattccgagaggctgagtccttcacacaactttctgaagaaatccagatggcagttgtatggtgcaggaaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaa

SEQ ID NO: 1322 - DNA, 2655 bp, Homo sapiens
aggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaagtttgatcactatgatcatctcacccacagacagaggatgcagggcttcatttttgttcccaaaaacaggggcaccgtagatacgtaaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttta

SEQ ID NO: 1323 - DNA, 2480 bp, Homo sapiens
ggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttta

SEQ ID NO: 1324 - DNA, 1490 bp, Homo sapiens
accctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaacatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtg

SEQ ID NO: 1325 - DNA, 2365 bp, Homo sapiens
gaggtcacaagctctggtgccccaaaatggctctggtcctcagatatagttggttgccaccctgggagtgagaggaaccaggaaagcagcacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttt

SEQ ID NO: 1326 - DNA, 3326 bp, Homo sapiens
agtagagtttagaatttggaacggggatgggtactggtctttacagttaacacaacctggagtagcccatgccatactgtgtccttttaagtcagtaaattgaactaagtcggttattcggcaagcagttcctataaaaaactacatggctaagatgtacacgttggataattccatgcccatcttggcattgcgaccaggagcttctgcatcccttgcttccaaagcgaaccagtgaaacatctttttattcttgcaggttcttaatgattgaccacaagcagatctttcaccctcggatctctagctacaaaaggaaccactggctcaatgacctgtaagggccgtttcagcacatccattctgtccatctccaagccttcaccgtagggaagaacttttgctctcagtcacctctcagagagctctctttatagctgaaggtccctctcatgagttacatcaagagtaacctagaattatatcagcaatacacagccatggcccccaagctactggcccgcatctccaaactcctcatgatctgccagaatgcaggcatttctgtaccaaaaggcatcagaaacatctttgagttcacttgggaagagctcatcagtgacccttcagtgcctaccccgtccgacatcttgggcctggaggtcagctttggagcccccctggtggtgctcatggaacccacctttgtgcaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaagggccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccatcacctgcctctttaatgacatacctggattctccttgctggccctattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggctgaaccgcagaatcagcaacatggacgacaaggtgtataagatgagccgagccctggctgagatcaagaagcggtttcagaagacagtgactcagttcattaattctatcttgctggccgcaggtctgtttaccattgaatatcccaccaaaaaggaggaggaagaatttgttcggttcaagatgagatccagaactcatcccgagcggctccccaagctaagtttatactcaggagaaagtcttttacgatctcagtcaggccacctggaatcctcaattgcagagactttgaaggatgagcctgagtctgctcctgtgagcccagttcggaagaccaccaaaatccacaccaaagccaaggtcacatccagagggaaggcccgcgaggggcgcagccccaccaggtgggcggccttgccctcagactgcccgctggtgctgcggaagctcatgctcaaggaagacacccgtgctggctgcaagtgcctggtgaaggcgcccctggtctctgacgtggagctggagcgcttcctgttggcgccccgagaccccagccaagtgctggtgtttgggatcatctcaagccagaactacaccagcactgggcagctccagtggctgctgaacactctctacaaccaccagcagcggggccgtggctccccctgcatccagtgccggtatgactcctaccgcctgctgcagtatgacctggacagccccctgcaggaggaccctcccctgatggtgaagaagaactctgtggtgcaggggatgattctgatgtttgccggggggaagctcatttttgggggccgtgttttgaatggatatggcctcagcaagcagaatctgctgaaacagatcttccggtctcaacaggattacaagatgggctacttcctgccggatgactacaaattcagtgttcccaactctgtcctgagcctggaggattctgaatcagtcaagaaagccgagtcagaagatatccaaggaagcagctcctcattggccctggaagactatgtggagaaggagttatctctggaggctgagaagacaagagagcctgaagtggagctacatcctctcagcagggacagcaagataactagttggaagaagcaggcctccaagaagtagcgccatcctggcagcagccaagtgagccaggccccggcccggggtgctggggcttcttgccagcccagccctgcctccccggtctcccaccctgtcctccaagcttctataataaaccagcgggcctccagcattggggtgaggctctggggaaggaca

SEQ ID NO: 1327 - DNA, 2744 bp, Homo sapiens
gtccttttaagtcagtaaattgaactaagtcggttattcggcaagcagttcctataaaaaactacatggctaaggttcttaatgattgaccacaagcagatctttcaccctcggatctctagctacaaaaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaagggccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccatcacctgcctctttaatgacatacctggattctccttgctggccctattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggctgaaccgcagaatcagcaacatggacgacaaggtgtataagatgagccgagccctggctgagatcaagaagcggtttcagaagacagtgactcagttcattaattctatcttgctggccgcaggtctgtttaccattgaatatcccaccaaaaaggaggaggaagaatttgttcggttcaagatgagatccagaactcatcccgagcggctccccaagctaagtttatactcaggagaaagtcttttacgatctcagtcaggccacctggaatcctcaattgcagagactttgaaggatgagcctgagtctgctcctgtgagcccagttcggaagaccaccaaaatccacaccaaagccaaggtcacatccagagggaaggcccgcgaggggcgcagccccaccaggtgggcggccttgccctcagactgcccgctggtgctgcggaagctcatgctcaaggaagacacccgtgctggctgcaagtgcctggtgaaggcgcccctggtctctgacgtggagctggagcgcttcctgttggcgccccgagaccccagccaagtgctggtgtttgggatcatctcaagccagaactacaccagcactgggcagctccagtggctgctgaacactctctacaaccaccagcagcggggccgtggctccccctgcatccagtgccggtatgactcctaccgcctgctgcagtatgacctggacagccccctgcaggaggaccctcccctgatggtgaagaagaactctgtggtgcaggggatgattctgatgtttgccggggggaagctcatttttgggggccgtgttttgaatggatatggcctcagcaagcagaatctgctgaaacagatcttccggtctcaacaggattacaagatgggctacttcctgccggatgactacaaattcagtgttcccaactctgtcctgagcctggaggattctgaatcagtcaagaaagccgagtcagaagatatccaaggaagcagctcctcattggccctggaagactatgtggagaaggagttatctctggaggctgagaagacaagagagcctgaagtggagctacatcctctcagcagggacagcaagataactagttggaagaagcaggcctccaagaagtagcgccatcctggcagcagccaagtgagccaggccccggcccggggtgctggggcttcttgccagcccagccctgcctccccggtctcccaccctgtcctccaagcttctataataaaccagcgggcctccagcattggggtgaggctctggggaaggaca

SEQ ID NO: 1328 - DNA, 2858 bp, Homo sapiens
acagttaacacaacctggagtagcccatgccatactgtgtccttttaagtcagtaaattgaactaagtcggttattcggcaagcagttcctataaaaaactacatggctaagatgtacacgttggataattccatgcccatcttggcattgcgaccaggagcttctgcatcccttgcttccaaagcgaaccagtgaaacatctttttattcttgcaggttcttaatgattgaccacaagcagatctttcaccctcggatctctagctacaaaaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaagggccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccatcacctgcctctttaatgacatacctggattctccttgctggccctattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggctgaaccgcagaatcagcaacatggacgacaaggtgtataagatgagccgagccctggctgagatcaagaagcggtttcagaagacagtgactcagttcattaattctatcttgctggccgcaggtctgtttaccattgaatatcccaccaaaaaggaggaggaagaatttgttcggttcaagatgagatccagaactcatcccgagcggctccccaagctaagtttatactcaggagaaagtcttttacgatctcagtcaggccacctggaatcctcaattgcagagactttgaaggatgagcctgagtctgctcctgtgagcccagttcggaagaccaccaaaatccacaccaaagccaaggtcacatccagagggaaggcccgcgaggggcgcagccccaccaggtgggcggccttgccctcagactgcccgctggtgctgcggaagctcatgctcaaggaagacacccgtgctggctgcaagtgcctggtgaaggcgcccctggtctctgacgtggagctggagcgcttcctgttggcgccccgagaccccagccaagtgctggtgtttgggatcatctcaagccagaactacaccagcactgggcagctccagtggctgctgaacactctctacaaccaccagcagcggggccgtggctccccctgcatccagtgccggtatgactcctaccgcctgctgcagtatgacctggacagccccctgcaggaggaccctcccctgatggtgaagaagaactctgtggtgcaggggatgattctgatgtttgccggggggaagctcatttttgggggccgtgttttgaatggatatggcctcagcaagcagaatctgctgaaacagatcttccggtctcaacaggattacaagatgggctacttcctgccggatgactacaaattcagtgttcccaactctgtcctgagcctggaggattctgaatcagtcaagaaagccgagtcagaagatatccaaggaagcagctcctcattggccctggaagactatgtggagaaggagttatctctggaggctgagaagacaagagagcctgaagtggagctacatcctctcagcagggacagcaagataactagttggaagaagcaggcctccaagaagtagcgccatcctggcagcagccaagtgagccaggccccggcccggggtgctggggcttcttgccagcccagccctgcctccccggtctcccaccctgtcctccaagcttctataataaaccagcgggcctcca

SEQ ID NO: 1329 - DNA, 3687 bp, Homo sapiens
ggggaaggcctggcacgctccagccaaccagggcgtcacctgcagctcgtccccctgcccgggcttgcctcgagcgccctgccgccgccggagcggggagggtgttgggggcaggtggagccgggagggcccagctgagaattcagggttgggggctcagagggcactgcggctaggagcccgtcaaagcctgtcgcccaccggggcgagggcaggtgggagcgcctggccgtgcgtcgcgcgctggttggccagctgacgccccagtgcgcatgcgcgtccgaacagccctgcgggcggagcgactgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccggatttcgagcagtcaaatttactttgcacaccagagatctgctaagcacagtgttatatattctcaactcctgcagtttatctgttgaacatatccaaagcttgaatactaatatgcatacccagcctctcaaagaagctaaaaggatgcctgacaggcccatcaaatgggacaagtcttattactcctttactggattcaaggaccctgatgaagaccttgaacaagtctcgagagtggaaacaactctcacatcctggttagataacaatgggaaaagtgctgttaaaaagctaaagaacagtttgccacttagaaaagaactagatcgtttaaaagatgaactgtctcatcaattgcaactctcagatatcaggtggcagaggagctggggcatcgcccaccgctgtagccagctgcatagtttaagccgcttagcacagcagaatttggaaacacttaaaaaagcaaaagggtgtacaatcatatttacagaccgttctggcatgagtgcagtgggccatgtgatgctaggaacaatggatgtccatcaccactggacaaaactttttgaaagattgccaagttattttgaccttcagaggaggctgatgattttagaagaccaaataagctatcttttaggtggcatacaagttgtttatattgaagaattacagccagtattgacacttgaagaatattactctcttcttgatgtgttttataatagactgttgaaaagtagaatactatttcaccctcgaagtttgcgtggtttacaaatgatccttaacagtgacagatatgctccaagcttgcatgaactcgggcattttaatattccaacactctgtgatccagcaaatctccagtggtttattctcaccaaagctcagcaggcaagagagaacatgaaaagaaaggaagagttaaaggttattgaaaatgaattgatacaggcatcaacaaagaaattttctttggagaagttatataaagagcccagcatttctagtatacaaatggtggattgttgtaagagacttctagaacaatcactgccttacctacatgggatgcacctctgcatttcacatttttactctgttatgcaagatggagacctttgtattccttggaattggaagaatggagaagccattaagtaacacagaaatctgttttatttttttaagagataagaaaggaacttaaattaaaaatatttaaatccacaatttgatataacagtattatttacataagaacaaagtttctaactgctgctttaaaagtagacttttttaaaaaaattaatttctgctaggagaggttttatatgccaggcgtggtggctcatgcctgcggtcccagctacttagggaggctaagataggaggatcacttgagcccaggaggccaaggttgcagtgggcccagattgcaccattgccctccagcctgagcaacagaacaagaccttgtctcaaaaaataataatgataatttaaaataaataagtaactaataaaaagattttatatcccagtcttatgatgttggttggcaaggctagataaaaagatgttagaatgaaagaacatatttttagtgatatgtaaatgaaggattctacaatagtcatatatttttatatgaatgaatgttgggttgggctggagaggtatgtgtgtgtaaatataaaggtctcacattcagagtatagctctgaaataatggaactcatgtctacaattcaacatgcatctgtatagttacatctcatgtaaatatacacagacatattttgcagccagtaattgacagttaatgtccaaaacaggtgattgataggtaacagaaattagataaccaccaattttgcccaagagaaagactagaaggactaaaagcagttgaatgtatggtactgacattgtcataagcagtctgataaccagtttattgaaacgtgtgcattaacagagaatttaattttaaacccataatttctcctatccattaaaatattataattgttagtagtatgaaaccaacaggaaatgttttttaatcatttagtgaggtgattcatttgtttcatgggcaaacactatccaggaaaagccttgcttgcctgtttcccaaagagctctaagaaatagaatcaagtgtaaaatggttcagaccattcaggatttcttgtcactcttctcaaccacgatcttcctgttattactgatgtttgaaaccctgtcattagccccggcctggttaaagcccctcagagtcacctctcattcatagcaatagaattcaaccccaagtggttgatggtgtccccagcacagccgagagacctgatctctggattcagtgcttttagctcttcgagtttaccctaagataccttcgggcaatatttttaaccaacccaaaagctcttcaggtcatttctgaagaggacaaggtgaatcttggcttggaacaccatttttgggctcttgctactgaatgaatcagaaaggaattttttctgaagagcattagaaagtaaaagagatgttaaaataagttcttgaagtatgttttatatttatctaaaacactgattttaaaagtttacattcaaatgtgtattcaaaagaagtactgatttgtaattattatagtttgtgtgtatcatcccttttaaccgtgcctaacaactgtacttaaattttgttttctagtgtaacaaatgtttcccataagattttctagagccaaataatgggagtgaaaaattccttaagtgttatataagaaaatatattagaaaatcagctttggattatacgatttctaaaatatactaatacagaatcctcagtaatatgttttgaattggattttttctcagaactgttacataataaataatacatcaaccagataa

SEQ ID NO: 1330 - DNA, 1996 bp, Homo sapiens
ctcctccagcagtccctttccccttcttccccaagatccagcgcgtgctcggttgcccttctccgttccttgcaggcccttgggtcaggacccaccacctgccggaccatcattttccgagtccctccggcctagtcggagtgctcgctcgcgcctcctaaagctctcagccgagcgcgccgagacccctcagggcggccgcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggatgatacatggaagagttttcaatgccctagtgatttttccttatgatgcatgctgctggaccactcccctacaacatcagttaatgtgtgctccaggaatacaaactgatatgaaaaatgacttatggtagatgtagttaagacagtcaatatattttaacattagaaaatacagtcagtccttcatatccatgggttttacatccatggattcaaccaacctcagactgaaaatattaggggaaaaaaatacatctgtactacacatgaacaaacttctctttcttgtcattattccctgaacaacacaggataacaactacttacatagcacttacattatattagatattataagtaatctagaaatgacttaaagtatatgggaggatacacataggttatttgcaaatactacactattttatatgagagacttgagcattcgcagatttcggtatccacgggaggtcctggaaccaatcccctatggataccaagggactgctatgtattacaaagccacatgctttggaattacttcagtgttccttctattttcattaacactgatatctagtttaatatgaaaaggaacttgaaatcttgaaaattagaacatcgttatttttttctacttgcaatggaaaatctattttgcttttttgcttctaggaaaatattctgattatgatatgtgatatgttggctactcaaagtcagaacttttcaaagtaatcagtaaattgaatcaacagaaaaatattcattaactcggggatgcattaataaagtttttaaattcaaaatgtatagaaaaatcaagcttagtaatactttaatattattctaccaatgtattttttttaattaagacttctgtatgcagcagggcatggtggcacacctgtagtcccagctactagggaggctgaggcaggaggattacttgagcccaggaattcaagcctgggcaacatagtgagtcctcatctcctaaatttaaaaaacaaacaacaaaaacttctacgtgtggtaaagggttaactcagcaagcttgggttgcttaaaccttgcacattccaaagaaaggtctgaccccagtgctgacctttgactggctactgggaaatgagctctgagcccctggataggaatgtttctgtttgcctgaggcctttgaccatgccagatagtttatgctaacaatgtgatttatagtgaatacctgttttcctgtgtctaagaccctgggctgcactgtattaatttgaccttgggtatttggggagctgagactgagtagctgaagtgagtcacataagcactaaatgcttacctgactgacccccagtaaaactctggacatccagacttggatgagcttccttgggtggcaacacttttacgtattgtcacacaccattgctggggggattaagcactgtctgtaaaactccactgtgaaatgacaactggaaacttgcacgtggtctctcctgattctgctctattcaccttttccctttgctgattttaatctccattcttttgttgtaataaaccataatggtgaataaaaca

SEQ ID NO: 1331 - DNA, 2178 bp, Homo sapiens
ggggaaggcctggcacgctccagccaaccagggcgtcacctgcagctcgtccccctgcccgggcttgcctcgagcgccctgccgccgccggagcggggagggtgttgggggcaggtggagccgggagggcccagctgagaattcagggttgggggctcagagggcactgcggctaggagcccgtcaaagcctgtcgcccaccggggcgagggcaggtgggagcgcctggccgtgcgtcgcgcgctggttggccagctgacgccccagtgcgcatgcgcgtccgaacagccctgcgggcggagcgactgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggatgatacatggaagagttttcaatgccctagtgatttttccttatgatgcatgctgctggaccactcccctacaacatcagttaatgtgtgctccaggaatacaaactgatatgaaaaatgacttatggtagatgtagttaagacagtcaatatattttaacattagaaaatacagtcagtccttcatatccatgggttttacatccatggattcaaccaacctcagactgaaaatattaggggaaaaaaatacatctgtactacacatgaacaaacttctctttcttgtcattattccctgaacaacacaggataacaactacttacatagcacttacattatattagatattataagtaatctagaaatgacttaaagtatatgggaggatacacataggttatttgcaaatactacactattttatatgagagacttgagcattcgcagatttcggtatccacgggaggtcctggaaccaatcccctatggataccaagggactgctatgtattacaaagccacatgctttggaattacttcagtgttccttctattttcattaacactgatatctagtttaatatgaaaaggaacttgaaatcttgaaaattagaacatcgttatttttttctacttgcaatggaaaatctattttgcttttttgcttctaggaaaatattctgattatgatatgtgatatgttggctactcaaagtcagaacttttcaaagtaatcagtaaattgaatcaacagaaaaatattcattaactcggggatgcattaataaagtttttaaattcaaaatgtatagaaaaatcaagcttagtaatactttaatattattctaccaatgtattttttttaattaagacttctgtatgcagcagggcatggtggcacacctgtagtcccagctactagggaggctgaggcaggaggattacttgagcccaggaattcaagcctgggcaacatagtgagtcctcatctcctaaatttaaaaaacaaacaacaaaaacttctacgtgtggtaaagggttaactcagcaagcttgggttgcttaaaccttgcacattccaaagaaaggtctgaccccagtgctgacctttgactggctactgggaaatgagctctgagcccctggataggaatgtttctgtttgcctgaggcctttgaccatgccagatagtttatgctaacaatgtgatttatagtgaatacctgttttcctgtgtctaagaccctgggctgcactgtattaatttgaccttgggtatttggggagctgagactgagtagctgaagtgagtcacataagcactaaatgcttacctgactgacccccagtaaaactctggacatccagacttggatgagcttccttgggtggcaacacttttacgtattgtcacacaccattgctggggggattaagcactgtctgtaaaactccactgtgaaatgacaactggaaacttgcacgtggtctctcctgattctgctctattcaccttttccctttgctgattttaatctccattcttttgttgtaataaaccataatggtgaataaaaca

SEQ ID NO: 1332 - DNA, 1844 bp, Homo sapiens
ctcctccagcagtccctttccccttcttccccaagatccagcgcgtgctcggttgcccttctccgttccttgcaggcccttgggtcaggacccaccacctgccggaccatcattttccgagtccctccggcctagtcggagtgctcgctcgcgcctcctaaagctctcagccgagcgcgccgagacccctcagggcggccgcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccggatttcgagcagtcaaatttactttgcacaccagagatctgctaagcacagtgttatatattctcaactcctgcagtttatctgttgaacatatccaaagcttgaatactaatatgcatacccagcctctcaaagaagctaaaaggatgcctgacaggcccatcaaatgggacaagtcttattactcctttactggattcaaggaccctgatgaagaccttgaacaagtctcgagagtggaaacaactctcacatcctggttagataacaatgggaaaagtgctgttaaaaagctaaagaacagtttgccacttagaaaagaactagatcgtttaaaagatgaactgtctcatcaattgcaactctcagatatcaggtggcagaggagctggggcatcgcccaccgctgtagccagctgcatagtttaagccgcttagcacagcagaatttggaaacacttaaaaaagcaaaagggtgtacaatcatatttacagaccgttctggcatgagtgcagtgggccatgtgatgctaggaacaatggatgtccatcaccactggacaaaactttttgaaagattgccaagttattttgaccttcagaggaggctgatgattttagaagaccaaataagctatcttttaggtggcatacaagttgtttatattgaagaattacagccagtattgacacttgaagaatattactctcttcttgatgtgttttataatagactgttgaaaagtagaatactatttcaccctcgaagtttgcgtggtttacaaatgatccttaacagtgacagatatgctccaagcttgcatgaactcgggcattttaatattccaacactctgtgatccagcaaatctccagtggtttattctcaccaaagctcagcaggcaagagagaacatgaaaagaaaggaagagttaaaggttattgaaaatgaattgatacaggcatcaacaaagaaattttctttggagaagttatataaagagcccagcatttctagtatacaaatggtggattgttgtaagagacttctagaacaatcactgccttacctacatgggatgcacctctgcatttcacatttttactctgttatgcaagatggagacctttgtattccttggaattggaagaatggagaagccattaagtaacacagaaatctgttttatttttttaagagataagaaaggaacttaaattaaaaatatttaaatccacaatttgatataacagtattatttacataagaacaaagtttc

SEQ ID NO: 1333 - DNA, 1884 bp, Homo sapiens
cggtccgcggggaaggggaccccgccgccttcccgaggtgagcggcgccccctgccgccagccggaggagctcagggccgctcgcaggaggccgggaacatggcggggcagcccgcggccaccggctcgccgtctgccgacaaggacggaatggagcccaacgtcgtggctcggatctcgcagtgggcagacgaccacctgcgcctagtccggaacatcagcactggaatggccatagctggaataatgttacttttgagaagcattcgactgacatcaaaatttacaagctcttcggatattccagtagaatttataagaagaaatgttaaactacgtggacgattacgccgaataactgagaatggtttagaaattgaacatatacctattactttacctattatagcttcattgagaaaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgagtaagggtggatatttcagcgtgaatctgaatgaagaaattttgagaagaggccttggcaaaactgttcttgttaaagggcttaaatatgattctaaaatctactggacagttcacagaaacttacttaaagctgaattaacagccttaaaaaaaggagaaggaatatggaaggaagactctgaaaaagaaagttacttagaaaaattcaaagattcctggagagaaatatggaaaaaggacagttttttaaaaacaacaggatcagatttcagcttgaaaaaagaaagttattatgaaaaacttaaaaggacttatgaaatatggaaagacaacatgaacaactgctccttaatactgaagttcagagaacttataagtcgcataaactttcgtagaaaagggtgaaacggtcaagaaatctagaggtaaccttctccaaagagtgaaatatgtaaatatatggacgtttttcattgaatcaaaatggaagttttgccaaatgatcaaagtgttagtccaatggtatttaaatattaaaaagagatgattattataagcataatgtcagaattaatttaaacaaattataattaatgtaatatgattttaggaaggatgaaacactttatgagaagttaccaggctgaatgatttacatatatagtgctaatgtgtgaagagaaagtttaactcttcacccactatgttgtttttagttattttgggctgccatattgaattttttgtttgtttgttttgagaaggcgtttcgctcttgttgcccaggctggagtgcaatggcgtgatcttggctcactgcaacctcctgcttcctgggttcaagcgattctcctgcctcagcctcctgagtagctgggattacaggcatgcaccaccatgcccggctaattttgcatttttagtagagacggggtttctccatgttggtcaggctggtctcaaactcttgacttcagatgatctacccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcctggattcaagtgattctcctgcctgagcctcccaagtacctgggattacaggagctcccaccaagcctggctaagttttgtattgccatattgaatttttgtttagaaaagatatgtgtttatgtttccagttttattacctttcactatttataataaaggaattctttatgcttta

SEQ ID NO: 1334 - DNA, 1931 bp, Homo sapiens
aggaggccgggaacatggcggggcagcccgcggccaccggctcgccgtctgccgacaaggacggaatggagcccaacgtcgtggctcggatctcgcagtgggcagacgaccacctgcgcctagtccggggacacggtattcctctctggcccaagctggagtgcagtggcacgatcatagctcactgctgctgctccacccacttcggccgaaaagatcctcccacttcagcctcccgagtagctggaaccacagaacatcagcactggaatggccatagctggaataatgttacttttgagaagcattcgactgacatcaaaatttacaagctcttcggatattccagtagaatttataagaagaaatgttaaactacgtggacgattacgccgaataactgagaatggtttagaaattgaacatatacctattactttacctattatagcttcattgagaaaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgagtaagggtggatatttcagcgtgaatctgaatgaagaaattttgagaagaggccttggcaaaactgttcttgttaaagggcttaaatatgattctaaaatctactggacagttcacagaaacttacttaaagctgaattaacagccttaaaaaaaggagaaggaatatggaaggaagactctgaaaaagaaagttacttagaaaaattcaaagattcctggagagaaatatggaaaaaggacagttttttaaaaacaacaggatcagatttcagcttgaaaaaagaaagttattatgaaaaacttaaaaggacttatgaaatatggaaagacaacatgaacaactgctccttaatactgaagttcagagaacttataagtcgcataaactttcgtagaaaagggtgaaacggtcaagaaatctagaggtaaccttctccaaagagtgaaatatgtaaatatatggacgtttttcattgaatcaaaatggaagttttgccaaatgatcaaagtgttagtccaatggtatttaaatattaaaaagagatgattattataagcataatgtcagaattaatttaaacaaattataattaatgtaatatgattttaggaaggatgaaacactttatgagaagttaccaggctgaatgatttacatatatagtgctaatgtgtgaagagaaagtttaactcttcacccactatgttgtttttagttattttgggctgccatattgaattttttgtttgtttgttttgagaaggcgtttcgctcttgttgcccaggctggagtgcaatggcgtgatcttggctcactgcaacctcctgcttcctgggttcaagcgattctcctgcctcagcctcctgagtagctgggattacaggcatgcaccaccatgcccggctaattttgcatttttagtagagacggggtttctccatgttggtcaggctggtctcaaactcttgacttcagatgatctacccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcctggattcaagtgattctcctgcctgagcctcccaagtacctgggattacaggagctcccaccaagcctggctaagttttgtattgccatattgaatttttgtttagaaaagatatgtgtttatgtttccagttttattacctttcactatttataataaaggaattctttatgctttatgtcc

SEQ ID NO: 1335 - DNA, 1547 bp, Homo sapiens
gaggagctcagggccgctcgcaggaggccgggaacatggcggggcagcccgcggccaccggctcgccgtctgccgacaaggacggaatggagcccaacgtcgtggctcggatctcgcagtgggcagacgaccacctgcgcctagtccggaacatcagcactggaatggccatagctggaataatgttacttttgagaagcattcgactgacatcaaaatttacaagctcttcggatattccagtagaatttataagaagaaatgttaaactacgtggacgattacgccgaataactgagaatggtttagaaattgaacatatacctattactttacctattatagcttcattgagaaaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgagtaagggtggatatttcagcgtgaatctgaatgaagaaattttgagaagaggccttggcaaaactgttcttgttaaagggcttaaatatgattctaaaatctactggacagttcacagaaacttacttaaagctgaattaacagccttaaaaaaaggagaaggaatatggaaggaagactctgaaaaagaaagttacttagaaaaattcaaagattcctggagagaaatatggaaaaaggacagttttttaaaaacaacaggatcagatttcagcttgaaaaaagaaagttattatgaaaaacttaaaaggacttatgaaatatggaaagacaacatgaacaactgctccttaatactgaagttcagagaacttataagtcgcataaactttcgtagaaaagggtgaaacggtcaagaaatctagaggtaaccttctccaaagagtgaaatatgtaaatatatggacgtttttcattgaatcaaaatggaagttttgccaaatgatcaaagtgttagtccaatggtatttaaatattaaaaagagatgattattataagcataatgtcagaattaatttaaacaaattataattaatgtaatatgattttaggaaggatgaaacactttatgagaagttaccaggctgaatgatttacatatatagtgctaatgtgtgaagagaaagtttaactcttcacccactatgttgtttttagttattttgggctgcctcagcctcctgagtagctgggattacaggcatgcaccaccatgcccggctaattttgcatttttagtagagacggggtttctccatgttggtcaggctggtctcaaactcttgacttcagatgatctacccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcctggattcaagtgattctcctgcctgagcctc

SEQ ID NO: 1336 - DNA, 1859 bp, Homo sapiens
ccactcttgctgtgcaaactcaatttcctgtatcctactctacgtattttcgaagcagtcatcgccatatggtatactctctctagattattttcttgggcatttgcctattgtcaccttttcttctcactagcatgtggctccatgagggcaaatacttaatctgttatgttcactggggcatctccagaacttgcctgaaacccagtaggtgttcaataagttctggagggatgaatgaatgactcctctcactgtaaggaagtttgggatatgtagtctatctgggcacatttctatctgttctctttgcaggggagaaagggatgaggatgttggataagcagctcagcatgttccccaacatgtaagggaatcaggtcgagttctacactctccttcttggtacacatcctcagaatgcaggaagtgcctgtgcttgctgtgagtctttgtggacagaggcaggatcatgctggctagaatctagtggacaagggcagcacattccccctgttcccaggtgggtccagagatgtcgcctgggagccagggcctggagttctgttactgtggctgagcttgcacccaagctacaagatgacatcctactcttccctcacctttctacaagtagaggagtctcttctcatggccaccattgtcccaggatgtgaggtctggaacagctgcagccattttgccaccatgggaaacctgggacatctgaactgactccatgaagcctgaagagaaagctaataagaaggcagagagaagaggaagagtcttggtctttggaaatatcttttggagctgctggatcaagtatcacttgaagtattattgaatttattccccgaaggagagcggctaagagtattgcccagccacaggctctcaaccaccaacccgagcctcagattctcctcacacagccacagctgtaccacatggcccacgtgaaatctgaatccacatgaaaacaatggcaacaagaaaaaggtgtaaactttccagaacaggcccagaatttgaaaatgtgataaagaggttattgtgcgcccgaacttttcacacaagaattggaggagatttaacacatggaataataaacagaggaaggcgggctaatgcagagcagatgggcctgcagggcagtgctcagcatttcaacatctttcccctggacctttggacccaaggtaagaaaactgaagttcagaaaagggaggggactgactcaatcccagctgctggcagatctgggactgcaaaccagccttccattgctccacacaggtgtctcttctcacgtggaatcacagcattggatggactgaaaagaggaagaggctgcaatggagcagcacacctggtgcgtggggatgcctggaaaacaaaattaggagagccctgggtcagcattgctctggcactggctgggccgggggccatcctgattctagaattatcttggttcctgggatagaaatgtccccagagtggagaagttcagttcaatccaacatccttatattgcaatgaggataaagaccacagaccctatggcctgtatgacccagctgcccatttctaggaacccattcctacagaaatgacaacatgcgtgtgcaaacagcaacaatgacaaacataccctgggatgctttccctctgtggtttgttatagtaagatagcggctacagcttatatatcatcaacagaggactggctaaatgatggcacttcattctgcagaatctttttttgtagtcaaaaagaacaagttagatctatatgtgtgaacatggaaaggtgtacatgacttaagtagaaaaattaagttgcagaacga

SEQ ID NO: 1337 - DNA, 1364 bp, Homo sapiens
actgtggctgagcttgcacccaagctacaagatgacatcctactcttccctcacctttctacaagtagaggagtctcttctcatggccaccattgtcccagattatctctccatacctcgtggctggagctgagaatgggggatgaatggcatagccaactcaagactgtcttttctactgtcttcagtgtctctttcagtgatatgaagttaaaaccaggatgtgaggtctggaacagctgcagccattttgccaccatgggaaacctgggacatctgaactgactccatgaagcctgaagagaaagctaataagaaggcagagagaagaggaagagtcttggtctttggaaatatcttttggagctgctggatcaagtatcacttgaagtattattgaatttattccccgaaggagagcggctaagagtattgcccagccacaggctctcaaccaccaacccgagcctcagattctcctcacacagccacagctgtaccacatggcccacgtgaaatctgaatccacatgaaaacaatggcaacaagaaaaaggtgtaaactttccagaacaggcccagaatttgaaaatgtgataaagaggttattgtgcgcccgaacttttcacacaagaattggaggagatttaacacatggaataataaacagaggaaggcgggctaatgcagagcagatgggcctgcagggcagtgctcagcatttcaacatctttcccctggacctttggacccaaggtgattgcatgctggtgtctttagctaaaaataaagttaatgtctttggggcaatcataaatatggctgcttcagtttctggggtgattggtggtctaaagttttcaagaacctactatgtgaaaggcatttgacattcactaatttaatcccaactactactccattttgaaggaaaaaaatgaaggctctgaaagtgtaaatcgcttactgaagggcacacggccaggatgacagcggagccaggatcaccccaggtctgtctcattgcatatgtcatggctctgcaaactggggcaataggtgagcagggagaagagtcatggccaaataaaattgagacataccgatacacacacacacacacacacacacacacacacatttacacggtaacagccttattaaggtacaactaatgtacaataaggtgtacatatttaaaggatactatttgataagttttgacatatgtctgtacctgggaaaccatcactacaatcatgatggtgagcatatctaatactctcaaaagtttcctcttgccttttgtaattccattctgccatcccacctgtccctcccactcctgatcccaggcaaccactg

SEQ ID NO: 1338 - DNA, 1528 bp, Homo sapiens
ctgatcattgagagagtgacacctggtcttaggcttagaagaggagtagaagagagccagtgaagtcagggaaggcttccaaggcaaaaggaccagcaaaagggcagcacattccccctgttcccaggtgggtccagagatgtcgcctgggagccagggcctggagttctgttactgtggctgagcttgcacccaagctacaagatgacatcctactcttccctcacctttctacaagtagaggagtctcttctcatggccaccattgtcccaggatgtgaggtctggaacagctgcagccattttgccaccatgggaaacctgggacatctgaactgactccatgaagcctgaagagaaagctaataagaaggcagagagaagaggaagagtcttggtctttggaaatatcttttggagctgctggatcaagtatcacttgaagtattattgaatttattccccgaaggagagcggctaagagtattgcccagccacaggctctcaaccaccaacccgagcctcagattctcctcacacagccacagctgtaccacatggcccacgtggtatggtgctaattcctctgacatctaattttcactttttggcaatatttggtctcatcaagctttacacataaatattttcagcaaagtgctccaaatgcctttttcagaaatctgaatccacatgaaaacaatggcaacaagaaaaaggtgtaaactttccagaacaggcccagaatttgaaaatgtgataaagaggttattgtgcgcccgaacttttcacacaagaattggaggagatttaacacatggaataataaacagaggaaggcgggctaatgcagagcagatgggcctgcagggcagtgctcagcatttcaacatctttcccctggacctttggacccaaggtgattgcatgctggtgtctttagctaaaaataaagttaatgtctttggggcaatcataaatatggctgcttcagtttctggggtgattggtggtctaaagttttcaagaacctactatgtgaaaggcatttgacattcactaatttaatcccaactactactccattttgaaggaaaaaaatgaaggctctgaaagtgtaaatcgcttactgaagggcacacggccaggatgacagcggagccaggatcaccccaggtctgtctcattgcatatgtcatggctctgcaaactggggcaataggtgagcagggagaagagtcatggccaaataaaattgagacataccgatacacacacacacacacacacacacacacacacatttacacggtaacagccttattaaggtacaactaatgtacaataaggtgtacatatttaaaggatactatttgataagttttgacatatgtctgtacctgggaaaccatcactacaatcatgatggtgagcatatctaatactctcaaaagtttcctcttgccttttgtaattccattctgccatcccacctgtccctcccactcctgatcccaggcaaccactg

SEQ ID NO: 1339 - DNA, 1678 bp, Homo sapiens
acatcctcagaatgcaggaagtgcctgtgcttgctgtgagtctttgtggacagaggcaggatcatgctggctagaatctagtggacaagggcagcacattccccctgttcccaggtgggtccagagatgtcgcctgggagccagggcctggagttctgttactgtggctgagcttgcacccaagctacaagatgacatcctactcttccctcacctttctacaagtagaggagtctcttctcatggccaccattgtcccaggatgtgaggtctggaacagctgcagccattttgccaccatgggaaacctgggacatctgaactgactccatgaagcctgaagagaaagctaataagaaggcagagagaagaggaagagtcttggtctttggaaatatcttttggagctgctggatcaagtatcacttgaagtattattgaatttattccccgaaggagagcggctaagagtattgcccagccacaggctctcaaccaccaacccgagcctcagattctcctcacacagccacagctgtaccacatggcccacgtgaaatctgaatccacatgaaaacaatggcaacaagaaaaaggtgtaaactttccagaacaggcccagaatttgaaaatgtgataaagaggttattgtgcgcccgaacttttcacacaagaattggaggagatttaacacatggaataataaacagaggaaggcgggctaatgcagagcagatgggcctgcagggcagtgctcagcatttcaacatctttcccctggacctttggacccaaggtgattgcatgctggtgtctttagctaaaaataaagttaatgtctttggggcaatcataaatatggctgcttcagtttctggggtgattggtggtctaaagttttcaagaacctactatgtgaaaggcatttgacattcactaatttaatcccaactactactccattttgaaggaaaaaaatgaaggctctgaaagtgtaaatcgcttactgaagggcacacggccaggatgacagcggagccaggatcaccccaggtctgtctcattgcatatgtcatggctctgcaaactggggcaataggtgagcagggagaagagtcatggccaaataaaattgagacataccgatacacacacacacacacacacacacacacacacatttacacggtaacagccttattaaggtacaactaatgtacaataaggtgtacatatttaaaggatactatttgataagttttgacatatgtctgtacctgggaaaccatcactacaatcatgatggtgagcatatctaatactctcaaaagtttcctcttgccttttgtaattccattctgccatcccacctgtccctcccactcctgatcccaggcaaccactgatctgctttctgtcactatagattagttacattttctagaattttatataaatgaaataatacaatatgtactatttttctgtgtttctttcactcagcaaaattattttgagattcattcatgttattgcttgtttattcctttatattgttgagtagttattccattgtatgaatatgccacaatttgtttatctgttcatctacatatggacatctatagatgtttgcacttttgggctattaaaaatcaagttgatgtgaatgtttgta

SEQ ID NO: 1340 - DNA, 1216 bp, Homo sapiens
ccactcttgctgtgcaaactcaatttcctgtatcctactctacgtattttcgaagcagtcatcgccatatggtatactctctctagattattttcttgggcatttgcctattgtcaccttttcttctcactagcatgtggctccatgagggcaaatacttaatctgttatgttcactggggcatctccagaacttgcctgaaacccagtaggtgttcaataagttctggagggatgaatgaatgactcctctcactgtaaggaagtttgggatatgtagtctatctgggcacatttctatctgttctctttgcaggggagaaagggatgaggatgttggataagcagctcagcatgttccccaacatgtaagggaatcaggtcgagttctacactctccttcttggtacacatcctcagaatgcaggaagtgcctgtgcttgctgtgagtctttgtggacagaggcaggatcatgctggctagaatctagtggacaagggcagcacattccccctgttcccaggtgggtccagagatgtcgcctgggagccagggcctggagttctgttactgtggctgagcttgcacccaagctacaagatgacatcctactcttccctcacctttctacaagtagaggagtctcttctcatggccaccattgtcccaggatgtgaggtctggaacagctgcagccattttgccaccatgggaaacctgggacatctgaactgactccatgaagcctgaagagaaagctaataagaaggcagagagaagaggaagagtcttggtctttggaaatatcttttggagctgctggatcaagtatcacttgaagtattattgaatttattccccgaaggagagcggctaagagtattgcccagccacaggctctcaaccaccaacccgagcctcagattctcctcacacagccacagctgtaccacatggcccacgtgaaatctgaatccacatgaaaacaatggcaacaagaaaaaggtgtaaactttccagaacaggcccagaatttgaaaatgtgataaagaggttattgtgcgcccgaacttttcacacaagaattggaggagatttaacacatggaataataaacagaggaaggcgggctaatgcagagcagatgggcctgcagggcagtgctcagcatttcaacatctttcccctggacctttggacccaaggaaaaaaatga

SEQ ID NO: 1341 - DNA, 1812 bp, Homo sapiens
cttgtactgagtgacctttcaggcagaatgtagactgagcgctcctgctactgctgcctgttgctgagaggaagaccgcagaaaattctggattcaaacatttattgctttttttgttttgctttgtttttgttttctttccttttgccttcagaagatgaacaatgaaaccacaaccctgatatccttgaaggaggcaatgaaaagagtagaccacaaactccaagcgttagaaacacagttcaaagaactagacttcaccaaggataacctgatgcagaaattcgaacatcatagtaaggctttggcaagccaagcagcccaagatgagatgtggacagcagttcgggcactccagctcacttcaatggaattgaatattttatacagctacgtcattgaagtacttatctgcttgcatactcgtgtgcttgagaagctgccagacctggtgagaggtcttccaaccttagcctctgtactcagaagaaaagttaagaacaagcgcgttagagttgtatgggagtccatactggaggagtgtgggctgcaagaaggagacatcacagcactttgtaccttctttattgcacgtggtaacaaggcagaacactatactgctaaagtgaggcagatgtacatcagggatgtcacgttcctaattactaacatggtaaagaaccaggctctgcaggacagtttgctgagggctgtgcaggtaattgagaaggggaaagcagttaggacccctgaaaagcaaaagtcatccctcgaagagttgataccatctgtcaaaaactaacctgttaccctatgacccagtgattccacctacagtaatttatcttggaaacagcaaaaagtatgcacaatttattatagtcttatttttatagcaaagagtgagaggatgttaaataaattatgacaaattgatacaatagatactttctttgcagccatataaaagaatgaagaagctctttgtgtaatgatatgaagtgatcaccaaatgtattgttgttttcaaatgtttatttccaatatacattgctaagtggaaaaaaggtgacaaatatatatatataaatatatatataacacatattagtttacatatccataaacttcttctgcagagatacacaagacagtgataacattagttgtcaggaaagaaagctaagaggctaggggtcaaagacaagaggaagtcttttcactgttaatccattttttacattttcaattttgaaccatgtgaatgtattacctatttaaaaaataaacaaggccggacatggtggctcatgcctataatccaagcaccttaggaggccaaggtaggaggatcacttgagctcaggggtttcagaccagcctgggcaacacagtgatagcaataggaggcaggtaaattcctaggcagacagggaggggtccctggtgaaactcaaccttcaagccaaggacagtctaaagcctgaaaaccaagctatgagttctggataaatccatgagccagactgagagctcccattctcgtctggcaccctctctcctgattggtccttacccttcacctattttatacatacctacccttccgcgattggtcctctacactatcgtgcctatttctgaatggtgctttgtcaagcatagccacagaccaatcagcatgcacttgcccatttctagcccacaaaaacccatagactcaggctcgtggccagcaacccaccttcgggtcccctctcactgccaagagccgttctgtcactcaataaattctactttgccttactcact

SEQ ID NO: 1342 - DNA, 1494 bp, Homo sapiens
ctattttaggccaaggctgggaggcagccaggccttccctgggctcacaaaggagccactgctgcatttgtccagtcctgctactggatgccatcattggcccccgactgcccactgcttgccatgcctgaggagacccaagaagactccgtggcgccaatgatgcccagccagaggagcagggggccattggcccccaaccacgtgcatgaggtatgcctgcaccaggtggagtccatcagcgacctacatagtggagcaggcacactgcgcccctatctaactgaagaggcacgaccgtgggatgagctgctgggcgttttgccgccgtcactgtgtgcccaggctggctgcagccctgtgtacagacgaggagggttcctgctgctgctcgcgctgctggtgctcacttgcctagtgctcgcactcctggctgtctacctgagcgtgctgcagagtgaatccctgcgcatcctggcacacacgctccgcacgcaggaggagacactactcaaactccgcttggccagcctcagccagcttcggaggctcaactccagtgaggcccaagcacccagctgagatgccatttggatctggggcctgggggtgtgtgttggtgggggaataaagtggctatgggcaggtctctccttccctactgctggctgccacatctacactatttccttggtgagatttttgtacaagaacctgttgttaacttaatggctgcctccctctcctgatctcttcaagccaggcctagccaagcctctggtgccaaagcctcgctttgggtggcccaaggtcaggggaaggggcaccagcctcctggctcctcctgtggcctgtcaacactctctggccaccccagatggcaggttctgaagtctagaaatagctgcccccatagcaatcacccaaactctgccagggctcccagtgagggtccagcctcagctcttaaagacaggctgggctctgagtagggggagaggcaccacctggggaagactgccttggagggcaaaggtgacatcgtggaagaccagttgggcccaagcctgggatagtagatggggagggagaacagaaaaatacccaggggttaagaccacagaaggctgaccgttctgtttaattatctgtaataatccttaaaaatcagcacacaaatccattccaggtagctttgccaccccacctgctgtggtggcatttgtccagatgccaccacccccctaagagtgggtcatcctgggggagcaaggcctgagaaaggaaaggaagggaaaggccccctagtgcctgccccacagccctgaggaaggcacatatttagcctggcctgagacaggacaggaaggggccacagggctgagtgcagggacaaaggggtcagggtcccaagtgtccgggcccccagctacccaccccatgtctgtttttggttttgtcattaaaaaaaataaagtgacaaatactggtgga

SEQ ID NO: 1343 - DNA, 850 bp, Homo sapiens
ttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagttctgaagaagatctacggaaggaacttcatttctgctgtttgcattggccatgattgggaacttcacgtatggacttggtgtggttttaaaggcaccagctgctacgtgtcacaagaatacttactttgtgcatcatcttccttggcttattgcaagttttggaatcttattccttaactcttttgtgtcttttgccatcagattgccattagagaataaacatgtatagctacttaatatatcacccaaaaagtacatatatatatatatatatatattctaagaagtgtaaatagctaatgctatagtcatttcattattatatttgaaatgttcatttataaggaaagtcttctctctcccaaagtctcctaattattattattctagcaaacgatcaaattcagatgaagatttcttggtttctttggttcttctgataaaaaaaaaaaagtggggccaagtttagaagca

SEQ ID NO: 1344 - DNA, 1598 bp, Homo sapiens
ctccacaggcgggcgttaaaccgcgcgggcagcgctgcgagagctcccaaagatgactcgagtggtgagccccgaggcggcgcgtttccccgccgcgccagacagggagagagggcctagatgtgccggcgccggttggtcagaggcggtggcctctgacctttccgagagctgagaaggcggcgggaggaaaaaaggcagacacacgctgggcgcccggccgctgacggcgggtaatgctcggacaacgtgccggcgacggggagcgcccgggcctcccgggcgacggcgaaggcggagtcccggcccggccagggaggcgcgcggagaggcccccccagcggccagccaaggtaaacaaggccgtgacgtgcgccgcgcacttaccgggagctgcggcctcgcggccgctgagcccgaacaagccagaccgggtcaggccgggccagagggaccggattggggcgaagcggcagcggaggcggcgggccgacgccggtcaagcccgcgctgcttcctccagaagagtcgtccccacagctccggaagtgcttggcgccgttgcgtcacttccggatcggggtcgacccacggtcgctcgggtcgcgacaggctcccggctagagggcctgtttagcgccgcctccttgaaacttagcgctctgacccagagtctgaccagggtacggcaggcgccgaccgcgtctggagccactattcgcctaccagcgtctcccgtcgagatgtttttaaccagcgcgtttctcaccggcttctcatttcactgtttgtactccgggatcgggcacggagaagacatcctggcgtcagtggagcagataaccattgtttctcggccgctatctggtcagaggggagctgggccgggaaattctgcctacaccccgaggcggtcgcagggtggccccagagccgcaaccacaccaggctttcgcttcccctgccgaggcctcgttcgccgcgcagttctccgacttacggtcaccgtgcaagattgcatcttaactgccttgcttgcagtttcttttcacagtataggagttgtcatcatgacttccagttaccttctgggaccggttgtcaaatgatgtggctagagacggaggctcactcagattgttgctgcaccacaatggaaatgccagtatgaagccgctgatgttaggaaggctccaggttgtgcaattccatagacaacaaatcaaatcatttccaaccatactggagtcgcgtatatacatattcaagacacctgtgcaggccgggcgcggtggctcaagcctgtaatcccagcactttgggaggccgaggcgagtggatcacgaggtcaggagatcgagaccatcctggctaacacggtgaaaccccgtctgtactaaaagtacaaaaaaattagccggacgtggtggcgggcgcctgtagtcccagctactcgggaggctgaggcaggagaatggcgtgaacccgggaggcggagcttgcagtgagtcgagatggcgccactgcactccagcctgggcgacagagcgagactctgtctcaaaataaaataaaataaaataaaaaataaaacaaat

SEQ ID NO: 1345 - DNA, 1770 bp, Homo sapiens
actcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtgggccaggagaccttctatgatgtctaccgtagaaaagcctcagaaagacagtatcagagaaggctggaagatgaatgagactgaacttcagcagtcaataaagtcaatatgaatttttactattggtttcagtgccttttaaaatatacttttcagatctcttgttctgacacagcttgtcctttatcagctgcacaatattccaataactgtttttgcaaagaatttttatagttctgtctctgcttgagtacttcccaagtcactgctggacagcacttgtgggaaaattatttcctcctaaaacactcactcgatgaatctagtccatgaaatatttcttaaacaattcaaggatcaatcaggatgcttttcagtgaagcccgaattgttttcggcaatctttgtttttaggcaactaattataaccttatttacttttttgcagaattcaaattaaattatggacacattctctattgccagatcatttaaaccaggataattatgcaggttgtatttctgccagctactagactataaactttttgctagggtggtggaaattcttgattgactacgcatttctcatgctagtgttcttgtgaacagaaatatgctcctcccttgcttggctcccctaaactgcaagggctggatcttcatgaggactgtgggcaacaggtttcacactactctaggatgaagatgttgctgttcgattcagctgctagaaacagttgctccttccatgagaaagtgaacctacacagtataaagcatcccagacttgagctaaatcagaggctcagtctattgagtgatttggcaatctgacccagtgtaagtttggatcagcctggtagaaaaagcagatacctttccatgcttgcatagccacatctaacatcgtttcaagcaaaaaaaaatctacatactaaagactaagtttcagaatagtttctaactattgcatgagaataaagctgatgcttaaggccatagggtatcctcaagttaatgatctctgccacaaacatgtctcctaattttttctagatttttcttctaattttagtccacttatcttagaaccaattcagtaaagaaccattaactaactactcccatctccttaaagcactacctacactacagtgcagcaagcccagagtcacagctgggagatggcttgaatgtgaaaggccagtaatgacctctgccatcagggagaggacggtggttcatcgtattctcatgcccagttgtgtcatctaggattcctggtaaacctaacctgataaaccatttttagtgacttgactgctgtataaaaactatagtatgattctcaattatatggccatactccatgtttgccctaacccaccttgttttaggagtttagtatttgatacatatagaaaatacgtcataccttttacaaagaataatagtaaacactaataaaaccattggctaac

SEQ ID NO: 1346 - DNA, 3347 bp, Homo sapiens
taatgacgtcacgttgtttcgcgggagaaattcgaaagtggattttgtgcaatttgacaggtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccatttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttagtgacaaacctacagtgacatttcctgttaaagagactctgccatcacagttttgtgataaaacttatgtgggttttgacatgggaatatgtaaaactgaaaacacaggaaaagaaatagaggagtatagtgacacattaagcaattttgaatctttcaagtggactgatgctgtatacggagataataaagaagatgctaataaacctattcaagaagtcagaattaactatgattttgctttacccccgaataaatctaaaggtataaacatgaatttacatattcctcatattcaaaaccagattgctgaaaacagtaatctattttcagaagatgctcaacctcagccttttattttgggaagtgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagttctcttcctcgggaagtaaagaagagactgcttttcaagctgttattcctaaacaaatagagagaaaaacctgtgaccctaagcctgttgagtttcaaggacatcaagtaaaaggatcagctactagtggtgtaatggtcagaggacacagctcacagctaggatgcagtcagtttccagatagcactgagtatgaaaactttatgacagagacaccagagttacctagcacgtgtatgcagattgacttcttgcaggtgacatcaccagaagaaaacatctctacattgagccctgtttctaccttttctttgaactcaagagatgaagacttcatggtagaattctctgagacgtccctgaaagcaagaactttacctgatgatcttcattttctcaacttggagggtagtcgttaccacattgctctaatatctgtctattcatttaagatgaagttttttatttgagagattattacactaaatatatcttagaacca

SEQ ID NO: 1347 - DNA, 3416 bp, Homo sapiens
gatttgaaagcggcggtttttggcttaggcggaggtgggcgggccaagttttgggtcctcatctggtgaggtcccgcgttaatgacgtcacgttgtttcgcgggagaaattcgaaagtggattttgtgcaatttgacaggtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaaatccagtgtctttaaaatcttgtagatatttaaaagccatctgattggattctgcatatcctttgtgttgtcttctggttccaaattattatggtcatgctagtgctattatccaactttatcttcaactatagcatacatttgttgagtgcccattatatatctcacacaagtaggttataggaaaacaagatagattcaagttagtccctgaaagtttctatgttccaggcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccatttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttagtgacaaacctacagtgacatttcctgttaaagagactctgccatcacagttttgtgataaaacttatgtgggttttgacatgggaatatgtaaaactgaaaacacaggaaaagaaatagaggagtatagtgacacattaagcaattttgaatctttcaagtggactgatgctgtatacggagataataaagaagatgctaataaacctattcaagaagtcagaattaactatgattttgctttacccccgaataaatctaaaggtataaacatgaatttacatattcctcatattcaaaaccagattgctgaaaacagtaatctattttcagaagatgctcaacctcagccttttattttgggaagtgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagaaaacagtgaagaaaaaaataaaacctaccctgcctctcagaatatttattaatgtttccagatttttttgtgtccagttaaaaaaaatggttagattgatgtatataaatagttttatatcctttccccttaatatcgttgtattatcttacattattaataattcttcttaaacatactttttaaaagttatttaccatccatcctatggctatcttgtgctttggacaaatagttctctgttttggtcatttaaataatttccagcattttgctattataagtaacactttaataaatgtttttacacat

SEQ ID NO: 1348 - DNA, 794 bp, Homo sapiens
gttgtttcgcgggagaaattcgaaagtggattttgtgcaatttgacaggtgaggtgaagtgtttctcgggatttcctaggaatgacttgagcgatttggggcgaagggacgaaagactctgctccttaagaagagaaccgggaaggatgctgtttggaaccaggattggggtggtcgcagtcacagctactcggactgcttgtagtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcaga

SEQ ID NO: 1349 - DNA, 2327 bp, Homo sapiens
atgaccagtctaataaatagccccattaataggagaccattacagaatgtagagggaaataataggtgccaaaggaaggcaaaaaactatggaaacaaatacttcattcactgccttgatcttgagaaaataaccctctccccaagaagaaaacatgacatagaaggtggagacaagttaaatgtgaagttttcacaattgcggtcacggaggcagcggaaagccgagccaggcgcctgcgcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttatata

SEQ ID NO: 1350 - DNA, 667 bp, Homo sapiens
aggagaggtgacctcgtgcagtttcagggaggagtccatcacctgactggactgggcctttcagggggacgagaacgtatttcttccaacgaaacctgaataaccagctatctgcctgggacgccgcgaggcagaagtaggcgggcccattgacttagtgtcaaggcggaggccgcgcttcatgccagcggtcacggaggcagcggaaagccgagccaggcgcctgcgcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaag

SEQ ID NO: 1351 - DNA, 2726 bp, Homo sapiens
gagccagtgacaggaggggccgggctggtacttcaggcgcccaggccggcggggcgcgctccggcggctcctgtcagcggcgggtgcggcggatcccagggcagccttcgggcggcggcgctgcctggtgcgtcgcggcgtggtcctccggcggctgtccggggcggtaggagttggctgcgggatgtgctcagccggggagctgctgcggggcggcgacggcggggaacgcgacgaggacggggacgcgctggcggagcgggaggcggcagggaccgggtgggatcccggggcgagcccgcggcggcgcggacagcggccgaaggagagcgagcaggatgttgaagactcacagaaccacactggtgagccggttggagatgactacaagaaaatgggaacactttttggtgaactgaacaaaaaccttatcaacatgggcttcacaaggatgtattttggagaacgaatagtggaaccagtaatagtcattttcttttgggttatgctgtggttccttggcctgcaagcccttggactagttgctgttctttgccttgttattatttatgtgcaacagtaaaacatggccgaattgaattgtttgacatttggtagccatatatgtaattgaagaagttatatatttcactttttgacaaccgaaaaagtttgccttgtttcaaatcatgtgctggctgttttgtaagtaaatttatacatggatgtcacttaaaactaaactcttgatcataacagggttgaatatatattttgaatatacattagcttattcaaaactcttgtttcactactgtgatctctgtctcctttatacacctctatccccatgccaaatcttaagtaacaccaccagaaagtgaacagggaaaataacaggacatggaattcaaatcaagcaatatagttcttataaagagttccaataaaacatttcagaagaaaaagtatgaaacaagctaaaagtaagtttcacttagaaaacttctccccactcacactccccaccaaataatctcatattatttgggaaatatttggatttcaattgtccctacccagcctaaactaaggtaaatgataattagcatacactaccttaatattgtgatgaaaatcagtaaagatagaacgttttctaaaggtcaaaaataatatatttattattactggggaaagctcccaggttaaatataacttttttaaaatgtaacatttggacctagacctactttaatatatcatttgaagtttcagacaattttggtgctaattactttttgtgagtttttaaagtctcatagcctagttgactgcaccctatggtaatgccatattttcttgtatctaacaagttgcatattttttcctagagagacattttcagtgtatttttttttagaaatttataattttatagttctttcataacacttattctgagttttgaaacaatgtatttcctatcttgacatggattttttcacaaaaaatttgtattttactgttgttttcaggaaaaaaatcagatcatttttctttgatatctatatcagaaaggtacaatattaacagtataaaaccaaatgcttaaatttggaacttagccaattttgataatctttttctaaggctaaagtcacatcagtaattggctagccatgttattaaggtgtcttaattcagcattttcaggttttatattgaaatacgcatttctttaaatattctttgaaaatggagaatggctttagtgatattttgggttttgttagagaacctaaaatctttacactttcatctcaaagattataaaggaaaggggggtagttaagatttagaattcaagttaaatttcagaaattggggcagtcaggcatttgtatctttggtagggcaacaagtaaaacatgtagagtgcttgctatcccacttcataaagcttttacccaatcttatttctaaacctctgtgcattcttagtgtcttctcattctgaaacagaaaataaggaaaaacatttaacttagttttctaaaatcagataatcctaaacaaaaatgttagtcagggtcactaaaaagtattgcacatttatataaatacagtccttttaaaatttgacttttaaaaaacaaaagactttgtacgatattgtgtttttattgcttttgcaatatttttatagtagcctttatgaactcagtataagtgcaagttgtttgaaaaggtgtttttattagtgcacaatagaattgtgaggttttcaatagatgtcatgagattttgtatatctacataaaatatcagtacatttttttctaatgctactggaaattttacttttcctttgcaacacataaatgatatgatgtacaaaataacagctctggttccaccagtacctaatgttgaaaacatttttaaagtaatttttaatactaactatttagtatactgtcagtactgtacatctgcacactggtgttaatagggtatatattaaattatataaagaaataagatattttgctgttattctttctacatatattattggtcagtacatcaaataatatttggctttgatatgggaaaaaacaaactttgcctatgtaatggaaataaaatattttcttttatgaaatatattagaatgcagattatactaatatcctgaaataaaactggtaatttatttggtt

SEQ ID NO: 1352 - DNA, 1892 bp, Homo sapiens
acgcacagcgtgtcgtaggcgtccgaagccgcaggctcccgcccggcttcccgggacgcacagggcaggcgctgggcatgcgcatgctcggcaggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaa

SEQ ID NO: 1353 - DNA, 612 bp, Homo sapiens
cactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcgggtgttgacagagtggcctcagacaaaactgtgaagtagagtttgcatatggtgttgcttaccttctggaaagtgagcctctccagctcaggccgcatctccatctccctttccaattctcacctccccttctccccttagctcagatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatg

SEQ ID NO: 1354 - DNA, 1339 bp, Homo sapiens
gttaggggaggatggtgaggactacaaaggtctccccacctcccgggggccgcggaggcggggctggatgaaggtcgacgtgcctcctccgggcggggcgctgccaggctctcagcctctctgtggaagggcagcctgcgcctgggtaccgaggctgctgcgcggcggacagcgggcgcgatgtatctccgcagggcggtctccaagactctggcgctgccgctgagggcgccccccaaccccgcgccgctcggaaaggacgcatctctgcgccggatgtcatctaacagattccctggatcatctggatcaaatatgatttattatctggttgtaggcgtcacagtcagtgctggtggatattatgcttacaagacagtcacatcagaccaagccaaacacacagaacataaaacaaatttgaaagaaaaaacaaaagcagagatacatccatttcaaggtgaaaaggagaatgttgcggaaactgagaaagcaagttcagaagccccagaagaacttatagtggaagctgaggtggtagatgctgaagaaagtcccagtgctacagttgtggtcataaaagaggcatctgcctgtccaggtcacgtggaggctgctccggagaccacagcagtcagtgctgaaaccgggccagaggtcacagatgcagcggcgagggaaaccacggaagtaaaccctgaaacaaccccagaggttacaaatgctgccctggatgaagctgtcaccatcgataatgataaagatacaacaaagaacgaaacctctgatgaatatgctgaactagaagaagaaaattctccagctgagtcagagtcctctgctggagatgatttacaggaggaagccagtgttggctctgaggctgcttcggctcaaggctaatctccagccggtagacatttcagcaacaaatgccatagggtgtctgataagtgcttttgtgtttttagtacacttagtttaaaaaaaaaaagacttattttctagaaaacgttaatgggtcttgaagatttttggcatccactgatagattttaggactgagagacttgagattgtacatttcttactactcttctactgtctgagatcagaatatgacattgcagtaaagagcttaaatagtttcatctttggtttttttttctagacacttttcttttatcccagtcatctctgaatttacattttatattaaagaaattgagctatccatacaacctgtatttactttaatttcactatgctttcagcttactttattgtatgatatgtaggtctaaaatatagtttgagtcaaataaaattagaaaagcttt

SEQ ID NO: 1355 - DNA, 2350 bp, Homo sapiens
atccgcagccaactgtgtggcggtccccactttcgcctagcggcaactccctcctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatcta

SEQ ID NO: 1356 - DNA, 1521 bp, Homo sapiens
gcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatc

SEQ ID NO: 1357 - DNA, 2338 bp, Homo sapiens
ggctccgaccgaggggcggagccgctgctcgagctgctgctggattgaactcagagaagccgggggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaacaattcctga

SEQ ID NO: 1358 - DNA, 2950 bp, Homo sapiens
ctcagagaagccggggtgttgaatgtttgttttctaaaggagacaatgattcataatttgtgacactgtaaatcctgaggtttatagaaaggattcatgactttgtaatggagttttgatgcttgagtaacctgcaggagaggatgacactttcgatgtcagagctgcacttgtgggcccaggatttggagaagtggagagaaggtctgatgggagttgaaggagctgcaggtccagcttcttccccatgccagcaagggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaacaattcctgactaaattgcaaaaccttttctactttttctttcttcatattaaacaaataaatattattaaaaatatagggccttatttaagaatgctacatagtgaccggacgtggtggctcacgcctgtaatcccaacactttgggaggccgaggcaggcaggtcacttgaggtcaggagttcgagaccagcctggccaacatggtgaaaccccgtctctactaaaaatacaaaaattaactgggcgtgctggtgtgcacctgtagtttcagctattcgggaggctgaggcagacaatggcttgaacctgggaggcagaggttgtagtgagctgagatggggccactgcactgcagcctgtgtgacagagggagactgtcttaaaaaataaacataaaataaataaataagaatgctacataggca

SEQ ID NO: 1359 - DNA, 736 bp, Homo sapiens
tcgagctgctgctggattgaactcagagaagccggggtgttgaatgtttgttttctaaaggagacaatgattcataatttgtgacactgtaaatcctgaggtttatagaaaggattcatgactttgtaatggagggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttg

SEQ ID NO: 1360 - DNA, 1927 bp, Homo sapiens
ctctatggctccgaccgaggggcggagccgctgctcgagctgctgctggattgaactcagagaagccggggctatttcgtgtagtggagcccatggcctccaagaagaggaactttctctaccacaagacaaattttggaaaggaatctgattggctcagcctggaccactttcattactagattagtcaccattattagggaaatggaaaactctaattgggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaa

SEQ ID NO: 1361 - DNA, 2285 bp, Homo sapiens
cttttgtatcagttaggatccatcaaagaagcagaactactttgtgagctaaagacctatggaattgtgggaggtggcagagcggtctgcagacttgcctctgagtctcttgttcagcctgaagttgctgcagatctactagactggcagtcagacagggatactggatgtggatgagagaaaagacaaactgaaacccttgggaacaaaacggaacctgcatcagcctctcaccaaccctagttttgatgcttgagtaacctgcaggagaggatgacactttcgatgtcagagctgcacttgtgggcccaggatttggagaagtggagagaaggtctgatgggagttgaaggagctgcaggtccagcttcttccccatgccagcaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaacaattcctgactaaattgc

SEQ ID NO: 1362 - DNA, 3251 bp, Homo sapiens
ttgaatctgcctcctcctatgggacagcgacattttcttaagttgcagatgatggagaaaattttttaaaagaaaaaaagggggcagggggagggaagcccagagtttggccaaatgcacgtttttcaagttcctgcttgagcttagattccctttccgctttaaggacatgccctctggaaagaagggtgttttgtttccagcccacacagacccaaacttttttcatcacgtgcctggtccgagccagtacgcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaat

SEQ ID NO: 1363 - DNA, 1203 bp, Homo sapiens
aaaaacaaggttagcctgcagcagagccgcagcagcaacagccaccaaagcgggggctgaaagggaagagaacttagatttgacctgtgcaaggacctcagcagcttggacacagcccactgcagaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtag

SEQ ID NO: 1364 - DNA, 815 bp, Homo sapiens
aaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcagcctgagagctcctgataaggaagaggctcccacagaagctggaaaaggccagctggaaaacgcagatgtgccttcctggttggttgagatgctgatcctacagcactcccgctgtgcctcagcagtgagctgggtgtaaaggcaggaggcttgctggggtctgacacttccctgccctcctccaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactg

SEQ ID NO: 1365 - DNA, 603 bp, Homo sapiens
gagcaaaaacaaggttagcctgcagcagagccgcagcagcaacagccaccaaagcgggggctgaaagggaagagaacttagatttgacctgtgcaaggacctcagcagcttggacacagcccactgcagagaactgttgattggtttcagaaaaatcttggtccatgtttttaaaccaaccaacaagtaatactaaagaacaaaccagcactttgggaggccgaggctggcggatcacaaggccaggagatcgagaccatcctggctaacacggtgaaaccctgtctctactaaaaatacaaaaaattagccgggcgtggtggtggaagcctgtagtcccagctactcaggaggctgagcaggagaatggcgtgaacctgggaggcagagcttgcagtgagccaagattgtgccactgcactccagcctgggcgacagagcgagactctgtctcaaaaaaaaaagaacaaaccaaaccaacttgctagaactactctttgagttctggatgaaaggagaagctggacatatgctacacaatgaaaagtcaaagcaggagggacacatctggggctctatgaggaggacagctttcatcctggg

SEQ ID NO: 1366 - DNA, 2889 bp, Homo sapiens
acttccgccttcctgcttccggtctggcggtgagtggggagtgggatccgatcccgtggggctatgtaggggaagttggtggctgcagctgccgtggttttctcctggtgtccagcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggtccaataattttattcactgttagtatttaattcactgtcagcttattaatgttttctgtacccattaatgaattttaaattacaaaaaattgtctagcagctacagtttaaaaatgaaactagacattaaaataaatttgataattttttataaagaggtcctggattttttttttttttttggaggaactaacattttaagttacattatgttatgcaagttagaatttcagttacagctaagcatacttgtaaaatttcaggactgtatctctcagaacctaaggaccactgagaatgtttatggaccagtttgaataacacttaatgctattcttttagattatcagtctctacttggtgccagtgtgagcaacacattataactcaaggcactgaaattattcagtgttaagatatatctataatatgtttggttttctgcaatcaagctgttcatggaaagaatttatgtacatgttttacttagggtcacattttagagtaaaagtattgaagcaaaggatatagtcataattctcagttacctactaaagttatggtttcatcagttctgttgtaacaacttaaaggtatttaaaggtctgtttttctataatttattagtcttaacacatgccagttttgtatttgtttgacatatgctttttttttccacttttttccatcatttagagagcctttctatatatgtgagattcatactttacagtgtgtgtgtgtgtgtgtgtgtgtgtgtgtgtgtaaggggctggagtatagagaatattgtgaggtttgggattcttcagaaaaatcacctctcactgcaacagagtactgttgttaaagaatcccatttgctattatctagaatacttttaagaaattgtttacttattacattgtttctgaagttctgagaactaagtacaatcaattaccattctaaagctggtcttgggggagaaagaaagctgtcccctggctgcctctaacaaacattttatcaaaaatcagcaaataaataaaagtttgtatgtcagaa

SEQ ID NO: 1367 - DNA, 584 bp, Homo sapiens
gccttcctgcttccggtctggcgcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccag

SEQ ID NO: 1368 - DNA, 2332 bp, Homo sapiens
acactactgggctccaagactgctcaaggtctcactgatagtcaaggcttgtgctcctttttttcagaagagtaagattaaagaaaaccactgtgaattaaaaagtgtgggtgccaacatgggacgggagtcccccctcactccatggatgacatagagggggcagaagattacagaattggcattgtcctgcgtggaagctgggccacccacagtggcgtgggaagcctctcagatgctggattctaatgggctcttgatcaccttggattgggctatttcattgttatcacaaaataaacaggatgctccaagtcatgttatggcagagaaccaaccagcttcacactggtcctctaaaccaatcctcacaacaggactgggagacaggtgttacctttcccactttacagagaatgaaacagagtggcaaagcctccgaaggaccctacacttcggacatcgcaaagcaggatctgagtcccggctcctctgtccaaacctacttgctaggctttctttcccatgtctactctatagctggaaaggtcgtggaggacacattttaggccaaccctctcggtttacaatccagagaggggagaccctcagaagccaagcgacatgtccacggctacgcggcgagtgtgtggcaacgtggaaggggagcccgagacgccctggtctctcccttctctcgcaggttcctttctccccgaacgcagcccgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgccagatcccgtgcagtcctggggaccctgagaagcaccgagccatccctgacccaggaactttccgcagactcgccgccatctgggagtgaagcaacatggatgcagtcagccaagtccccatggaagtcgtgcttcccaagcacatcctggatatctgggttattgtcctcatcatcctggccaccattgtcatcatgacctcgttgttgctgtgcccagccactgcagtaatcatctatcgcatgcggactcatccgatccttagtggggctgtttgagagcctcccaagagggccgggtgagggatgaggacaggcatcctatccccagcctcttcctgtcttcagaaaagcagcaggagggactttggggcatggacctgagttctggttttgattctgccacgagccagctgtgtgaatttggtcaagggacctaactctctgagttccaggttccttatctttcaaatggggatggtgatccctgccctttctacctcatagggatgtgagaaccacctgacttagtggatgtgaaagctgtttgtgatcagtaaagctaccacagatataagggtgttatgctgaatcctgagaagctttcaagaaccagagaacctgattgctgatgatggccttaaaggtggtgagggagatactgggggcagagcagactttgccagtgcccctcaggtcaaaccaagccaagagcaccctgtccccattccaaggggccagcagcactttggcccaaagtattttctttaaggtgccattccttcatgttttctcagtttggagggtgatgggtagagctttccagaaccttctccattccagaatctctgcccctgtgtaatctgaaggaaggctgtgccatctttgggcactgccaagggagttggggtgatgggcttctttctgcactggagtctcacatctgttagctttgacactcaagcaatgttggaaaatgcagggtgactgagttccctgcccagctttcgggatctctggcccccatccccttgtgtgtgtccctctgcccagctcctgctgtaattagctccacgtgtacccccttcactccctcccaccagctctgcagccagcctatggcaattatattttaagaggtgttcccaggacttttgggacctactaaaacaatgatggttattttagatgtgatgatttatatttatgtagagatatttctggaccactcaagctcttcgataccaaaatcaggagcatcttgggatttattaaattatgtaagaagatagcacagatatcgggatattattgtgtgaaaatgctgcttttactttgatgtgatctcattgatgtacacaaccaagttccaataaagtgctagaatgtg

SEQ ID NO: 1369 - DNA, 1683 bp, Homo sapiens
tctgtactaaaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagcacgctatgaggcaccattttccccaaagattgagaaactagcaatctccaaaagttctttagctttacctcaaggatccatgagtagtataaaatgtttacaaacaactgaagaacctccttgcataccatgtgtaatgattttgatattctataatgtgcctgctaccagaggaatggggaaggtggtgagaaagcacataatgcaaactccaggacctattggtaagctgcctgttttttcagtcagatcgcatcctcacacaatcactggtccaccttcagcaccccgcggtaaacctgtctctaccctgctcatttctaactctgtgtgcagctacctgactcaaagcttccagtttcctgaagttaggacaatagccaccaagaagagagccacaacccagggctcagttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaa

SEQ ID NO: 1370 - DNA, 1897 bp, Homo sapiens
tttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagagttgaatgccaccatggacaacaaaaggaaacatctcacaggaaaacagaaagaaaattaaggagagagaggaagagaatcaccaatgaaagaagacttatagggacagaaaaatctttacctcaaggatccatgagtagtataaaatgtttacaaacaactgaagaacctccttgtaaaggaatggggaaggtgatacaggcaaagcaactattaaatatatcttggcctcttgctgtctcattatcaaaacctctctgcattattcatgatgtactggaaagttttaagactatcaatttacaatcccctgcaggatttcaagcagttaccagtcactgcaaaaagggaagagataaattcagaaaaattttagtttacaaaaaaggaaccagtatcaaggggaaaaaaatagaaataaagagaaaatacttgatatctaaatcacgcccttttgttgtatgctcagttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgatgagtataccacaaggacagggagcccaaataaagaaaagtgtgtcagatgtaccaagaggacaggacaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaaggaggcaaatacaggaaggaagtacaacaaaaaagtggaagagtaaggataaattttttaaaggcccataa

SEQ ID NO: 1371 - DNA, 2125 bp, Homo sapiens
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtggtaatttatgttttcagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaatt

SEQ ID NO: 1372 - DNA, 2148 bp, Homo sapiens
ctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 1373 - DNA, 2148 bp, Homo sapiens
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 1374 - DNA, 2173 bp, Homo sapiens
tcccatcatttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 1375 - DNA, 2125 bp, Homo sapiens
ctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtggtaatttatgttttcagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaatt

SEQ ID NO: 1376 - DNA, 1683 bp, Homo sapiens; identical to SEQ ID NO: 1369

SEQ ID NO: 1377 - DNA, 1897 bp, Homo sapiens
tttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagagttgaatgccaccatggacaacaaaaggaaacatctcacaggaaaacagaaagaaaattaaggagagagaggaagagaatcaccaatgaaagaagacttatagggacagaaaaatctttacctcaaggatccatgagtagtataaaatgtttacaaacaactgaagaacctccttgtaaaggaatggggaaggtgatacaggcaaagcaactattaaatatatcttggcctcttgctgtctcattatcaaaacctctctgcattattcatgatgtactggaaagttttaagactatcaatttacaatcccctgcaggatttcaagcagttaccagtcactgcaaaaagggaagagataaattcagaaaaattttagtttacaaaaaaggaaccagtatcaaggggaaaaaaatagaaataaagagaaaatacttgatatctaaatcacgcccttttgttgtatgctcagttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgatgagtataccacaaggacagggagcccaaataaagaaaagtgtgtcagatgtaccaagaggacaggacaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaaggaggcaaatacaggaaggaagtacaacaaaaaagtggaagagtaaggataaattttttaaaggcccataa

SEQ ID NO: 1378 - DNA, 2076 bp, Homo sapiens
acacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaatt

SEQ ID NO: 1379 - DNA, 432 bp, Homo sapiens
gccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttga

SEQ ID NO: 1380 - DNA, 507 bp, Homo sapiens
gccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttga

SEQ ID NO: 1381 - DNA, 1978 bp, Homo sapiens
cttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggtgagcggaggagaagagggagggaggagagggggcggggagagaccctcctcaaagccggtgcgtggggcggagcgcgcgctgggttccgcgcaggcgcagagacacccgccgccccttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaagg

SEQ ID NO: 1382 - DNA, 614 bp, Homo sapiens
gcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctga

SEQ ID NO: 1383 - DNA, 1402 bp, Homo sapiens
gcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaagga

SEQ ID NO: 1384 - DNA, 813 bp, Homo sapiens
atggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaagg

SEQ ID NO: 1385 - DNA, 2850 bp, Homo sapiens
gagaacggggtagcccggcgcttacacatgtcacatgtgctttttaagacggccgggagcgcctgcgagctggatctggtggaggatgctgcggcaggtgcttcgcagagggctccagtcgttctgccacaggctgggtttgtgcgtgagccggcacccggtctttttcctcaccgtgcccgcagtcctgacaatcaccttcggcctcagcgcgctcaaccgcttccagcccgagggcgacctggagcgcctggtcgctcccagccacagcctggccaagatcgagcgcagcctggccagcagccttttccccctggaccagtccaaaagccagctctattcggacttacacacccctgggaggtatggcagggtgatcctcctctccccaaccggggacaatattttgctccaggctgaggggatcctgcagacccaccgagccgtgctggaaatgaaggatgggaggaacagttttattggacaccaactgggcggggtagtggaagtgccaaacagcaaagatcagcgggtcaagtcagccagagccattcaaatcacctactacctccagacctatggctctgccacccaagacctcataggggagaagtgggagaatgagttctgtaagcttataaggaagctccaggaggagcatcaagaactccagctctactctttagcatcctttagcctctggagggactttcataagaccagcatcctggccagaagcaaggtcctggtgagcctcgtgctgatcctgaccacagccaccctctccagctccatgaaggactgcttgcgcagtaagcccttcctgggcctcctgggggtgctcacagtatgcatctccatcatcacagcagcagggatcttcttcatcaccgatggaaagtacaactccaccctgctgggaatcccgttcttcgccatgggtcatggaactaaaggagtgtttgagcttctgtccggatggcggagaaccaaagagaacttgcccttcaaagacaggatagcagatgcctattctgatgtgatggtcacctataccatgaccagctccctgtacttcatcacttttggcatgggtgccagcccattcacaaacatagaggctgtgaaggtcttctgtcaaaacatgtgtgtctctattctgttgaactacttctacattttctccttctttggctcctgtctggtctttgctggccaactagagcaaaaccgctaccacagcatcttttgctgtaagatcccttctgcagaatacctggatcgcaaacctgtgtggttccagacagtgatgagtgatgggcatcaacagacgtcccatcatgagacgaacccctaccagcaccacttcattcagcacttcctccgtgaacattataatgaatggattaccaatatatatgtgaagccatttgttgtcatcctctatctcatttatgcctccttctccttcatggggtgcttacagatcagtgacggagccaacatcatcaatctactagccagtgattcgccaagtgtttcctatgccatggttcagcagaaatatttcagcaactatagccctgtgataggattctacgtctatgagcccctagagtactggaacagcagcgtccaggatgacctaagaagactctgtagtggattcactgcagtgtcctgggtggagcagtactaccagttcctgaaagtcagcaacgtcagtgccaataacaaaagtgacttcatcagtgtcctgcaaagctcatttttaaaaaagccagaattccagcattttcgaaatgatatcatcttctccaaggcaggggatgaaagcaatatcattgcttctcgcttgtatctggtggccaggactagcagagacaagcagaaagaaatcacagaagtgttggaaaagctgaggcccctatccctctcaaagagcatccgattcatcgtgttcaacccctcctttgtcttcatggaccattacagcttgtctgtcacagtgcctgttctgattgcaggctttggtgttctcctggtgttaatcctgacttttttcctagtgatccaccctctgggaaacttctggctaattcttagcgtcacctcaattgagctgggcgttctgggcttaatgacattatggaacgtcgacatggattgcatttctatcttgtgccttatctacaccttgaatttcgccattgaccactgtgcaccactgcttttcacatttgtattagcaactgagcacacccgaacacaatgtataaaaagctccttgcaagaccatgggacagccattttgcaaaatgttacttcttttcttattgggttagtcccccttctatttgtgccttcgaacctgaccttcacactgttcaaatgcttgctgctcactgggggttgcacacttctgcactgttttgttattttacctgtgttcctaacgtttttccccccttccaaaaagcaccacaagaaaaagaaacgtgccaagcgaaaggagagagaggaaattgaatgcatagaaattcaagagaacccggatcacgtcaccacagtatgaggggtatagaccagtggattatttttcttttccagtattgcacaatgatgcagggcaagtaaagctcagacctcagctgcttgggctggccaggggtaacaaggcaagtcagatcaagagtgcattattcatgacacttcaaggtgcctgcttcttggggggaagagggaataaaaaaagaggaaaaagttatttgcaaccttgttctcctctaaaaacaagtttctggatgtaatctgagagctcttccaaggaatggatgaatcaatggagtg

SEQ ID NO: 1386 - DNA, 3232 bp, Homo sapiens
gtgctttttaagacggccgggagcgcctgcgagctggatctggtggaggatgctgcggcaggtgcttcgcagagggctccagtcgttctgccacaggctgggtttgtgcgtgagccggcacccggtctttttcctcaccgtgcccgcagtcctgacaatcaccttcggcctcagcgcgctcaaccgcttccagcccgagggcgacctggagcgcctggtcgctcccagccacagcctggccaagatcgagcgcagcctggccagcagccttttccccctggaccagtccaaaagccagctctattcggacttacacacccctgggaggtatggcagggtgatcctcctctccccaaccggggacaatattttgctccaggctgaggggatcctgcagacccaccgagccgtgctggaaatgaaggatgggaggaacagttttattggacaccaactgggcggggtagtggaagtgccaaacagcaaagatcagcgggtcaagtcagccagagccattcaaatcacctactacctccagacctatggctctgccacccaagacctcataggggagaagtgggagaatgagttctgtaagcttataaggaagctccaggaggagcatcaagaactccagctctactctttagcatcctttagcctctggagggactttcataagaccagcatcctggccagaagcaaggtcctggtgagcctcgtgctgatcctgaccacagccaccctctccagctccatgaaggactgcttgcgcagtaagcccttcctgggcctcctgggggtgctcacagtatgcatctccatcatcacagcagcagggatcttcttcatcaccgatggaaagtacaactccaccctgctgggaatcccgttcttcgccatgggcatctccactgaatttacctcaagctagaaacaaatttagtttggaagaaagaaaggagagaaggaaggagagaaaaaactggagaggagaaaaatatcacatttggaagattatatgtgaagactcctaggatacaataaaatcatcatcatcgtcatcatcatcatcatcaccaccaataccatcagagcaatctgagagttcattctagtctaagaacccagccctctattttttggaggttaagtatcctccaggtatttctttcctccctgtgcttaacagctgtgtgtctgtaacccatactgtcttttctatctcccacctgactcctctcatgggaaactaaattggtttaaatcatatggaagcattataagtactgtttagtgatgaaaataaattgattccaatcatataggtactttcctaaatactgactgatgaagtttagatgtgctgtaatttataaataaaatgaaggaggttacctggcaatatgtgagagggaggaacaattatcgtgtttgagatttaaaggaaagagtaatgaacacttcccaaataattctatgagataaatattaccctgatactaaaaccagacaaaaacatcacaaggaaggaaaactacaggttaataactttatgaacttgagtgtaaaaattctcaataaaatactagcaagccaaattcaatgaacaaatgaggtttatttctatttatttttatttttttttatttttattttattttattattttttttttttgagacggagtcttgctctgtcgcccaggccggactgcggactgcagtggcgcaatctcggctcactgcaagctccgcctcccaggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccatgcccggcccaaatgaggtttattttataaatgcaagagtggtttaacatttgaaaatcattaacataatataccatcaatagaattaaggtcaaaaaccgcatggtcatctcaatagacaaagaaagggcatttgacaaactctaacaacattttatgacaacaaaataactctcaacaaactagtaatagaagggaacttgcttaatctgatacagatatccataaaaacccaaagctaatatcatatttaatggagaaagaatgaacttaaaagttgtacttcaatgaataccatcaagaaagtgaaaaacaaactcacagaatgggagaaaatattttcaaattatctatcttataagagacttgtatacagaatatttaaaggactattacagcttaataataaaaacacaacccaatttcaaagtggacagaagattcgaatagacatttattctaagaagataaacaagtggccaaaagtatatttaaaatgctcaaaataattagttattaaagaaatgcaaatcaaaaccacattgagcacatcatatccattaggatgactaaaatcaagaagtaaggcaataacaagtattgatgaggtaggttaggaactctttacacattgctgatgaaaatgtaaatgatgcagctcttttggaaaatagtctgacagttcctaaaaatgctaaacttagtattagcattttgattcagtaattccactgctaggtatatactcaagagaaatgaaaatatttatccacacaaaactgtacaaatgttcatagcaatattattcataatggcaaaaggtagacacaatccaaatgtccatcaactgatgaatggaaacataaaaagtggtatatgcatacaatggaatattattcagccattaaaaaggaaacaagtactgatacatgctccaatatggatgagcattgaaaatattttgataagtgaaagaagtcatgaaagtgtacataattgcatgattctatatatatgaaatgttcagagtaggcaaatatgtagagacaggaagtagatgagtagttgctgaggattggtgggttaggggatgaagccagggaatggagtcactgctaatgatacagaagttctttcaggttgatgaaatgttctgaaattgattatggcaatcattgcacaactttgtagtatactagaaacttttaaattgtacacttttaatcaatgaattgcttggcattatatcacaataaagctgttaaaaacaaac

SEQ ID NO: 1387 - DNA, 3053 bp, Homo sapiens
aagacggccgggagcgcctgcgagctggatctggtggaggatgctgcggcaggtgcttcgcagagggctccagtcgttctgccacaggctgggtttgtgcgtgagccggcacccggtctttttcctcaccgtgcccgcagtcctgacaatcaccttcggcctcagcgcgctcaaccgcttccagcccgagggcgacctggagcgcctggtcgctcccagccacagcctggccaagatcgagcgcagcctggccagcagccttttccccctggaccagtccaaaagccagctctattcggacttacacacccctgggaggtatggcagggtgatcctcctctccccaaccggggacaatattttgctccaggctgaggggatcctgcagacccaccgagccgtgctggaaatgaaggatgggaggaacagttttattggacaccaactgggcggggtagtggaagtgccaaacagcaaagatcagcgggtcaagtcagccagagccattcaaatcacctactacctccagacctatggctctgccacccaagacctcataggggagaagtgggagaatgagttctgtaagcttataaggaagctccaggaggagcatcaagaactccagctctactctttagcatcctttagcctctggagggactttcataagaccagcatcctggccagaagcaaggtcctggtgagcctcgtgctgatcctgaccacagccaccctctccagctccatgaaggactgcttgcgcagtaagcccttcctgggcctcctgggggtgctcacagtatgcatctccatcatcacagcagcagggatcttcttcatcaccgatggaaagtacaactccaccctgctgggaatcccgttcttcgccatgggcatctccactgaatttacctcaagctagaaacaaatttagtttggaagaaagaaaggagagaaggaaggagagaaaaaactggagaggagaaaaatatcacatttggaagattatatgtgaagactcctaggatacaataaaatcatcatcatcgtcatcatcatcatcatcaccaccaataccatcagagcaatctgagagttcattctagtctaagaacccagccctctattttttggaggttaagtatcctccaggtatttctttcctccctgtgcttaacagctgtgtgtctgtaacccatactgtcttttctatctcccacctgactcctctcatgggaaactaaattggtttaaatcatatggaagcattataagtactgtttagtgatgaaaataaattgattccaatcatataggtactttcctaaatactgactgatgaagtttagatgtgctgtaatttataaataaaatgaaggaggttacctggcaatatgtgagagggaggaacaattatcgtgtttgagatttaaaggaaagagtaatgaacacttcccaaataattctatgagataaatattaccctgatactaaaaccagacaaaaacatcacaaggaaggaaaactacaggttaataactttatgaacttgagtgtaaaaattctcaataaaatactagcaagccaaattcaatgaacaaatgaggtttatttctatttatttttatttttttttatttttattttattttattattttttttttttgagacggagtcttgctctgtcgcccaggccggactgcggactgcagtggcgcaatctcggctcactgcaagctccgcctcccaggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccatgcccggcccaaatgaggtttattttataaatgcaagagtggtttaacatttgaaaatcattaacataatataccatcaatagaattaaggtcaaaaaccgcatggtcatctcaatagacaaagaaagggcatttgacaaactctaacaacattttatgacaacaaaataactctcaacaaactagtaatagaagggaacttgcttaatctgatacagatatccataaaaacccaaagctaatatcatatttaatggagaaagaatgaacttaaaagttgtacttcaatgaataccatcaagaaagtgaaaaacaaactcacagaatgggagaaaatattttcaaattatctatcttataagagacttgtatacagaatatttaaaggactattacagcttaataataaaaacacaacccaatttcaaagtggacagaagattcgaatagacatttattctaagaagataaacaagtggccaaaagtatatttaaaatgctcaaaataattagttattaaagaaatgcaaatcaaaaccacattgagcacatcatatccattaggatgactaaaatcaagaagtaaggcaataacaagtattgatgaggtaggttaggaactctttacacattgctgatgaaaatgtaaatgatgcagctcttttggaaaatagtctgacagttcctaaaaatgctaaacttagtattagcattttgattcagtaattccactgctaggtatatactcaagagaaatgaaaatatttatccacacaaaactgtacaaatgttcatagcaatattattcataatggcaaaaggtagacacaatccaaatgtccatcaactgatgaatggaaacataaaaagtggtatatgcatacaatggaatattattcagccattaaaaaggaaacaagtactgatacatgctccaatatggatgagcattgaaaatattttgataagtgaaagaagtcatgaaagtgtacataattgcatgattctatatatatgaaatgttcagagtaggcaaatatgtagagacaggaagtagatgagtagttgctgaggattggtgggttaggggatgaagccaggga

SEQ ID NO: 1388 - DNA, 2405 bp, Homo sapiens
ggggcgtctcgggcgaggagaggaggtgaccccgcgaaagataataaatcatcattgatcaagatgtcttcagcacctgagcctccaacattcaaaaaggaaccacccaaagagaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaaattttaaggcctgaagtcaatattaaaaatatgagatatgagaaactgagttggctctgacaagtagtttttatagtgtcacaaatggttcatatatttcagtttccattttagctatttttgggacagaattttattttaatggaaaagatccttccactcagctactaaaataaggattaagaatatcccagagtaattggagtttttctttaaaaaaaaaaaaaaagtatgttttactgaggtatgatgattttgactacaactaaatgttatctattttagtgtttatgttaattaatgttaattaattttgtttatgttaatttgtgttaattaatgttactgtaatgttataaacataagaccaagtgttcttatagttatttaaaaactacaactactcaatggataaggaatagataaggtctccttattgtaccttttttttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccaggggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatgaaactaaataaaatctttactactgagccccaaatatgtatttgctatgcctgtctgtataatgtacttcatatagtttaaaatgcacttcagtgatacaaaatcccttttaaagactcttttgtttttgttttccctgtgtattttggctatcacaaaactagggttcttctgtttttaacttatgcatttaatgacacattgccatcttttagaattttttactattcaacagaataagctgatgtttggtggcagaggagttattagttgcgtgaactgtcaagagattgcagtgcaggagggcaacagaaactgtacaaggtgcagacttgagtcatgtaagatctatgtgaatgaaccaaagtaactagagtcagtcaagcacaaagctgtgaaaagtagtgtgtggaaagaatcatactgaattttaggaacaagtacctgactatgatactttttacagagtgactacaagttgtaggacagtctttgtgtgtgctgagtgtcaacagctgcctgcctatgtgttgatgttttcatcctttctttgttgaatgagggtataaccatcaaaaataaaatacctttcaaata

SEQ ID NO: 1389 - DNA, 2434 bp, Homo sapiens
ggggcggggcgtctcgggcgaggagaggaggtgaccccgcgaaaggaggatggacagaagaaaaagataataaatcatcattgatcaagatgtcttcagcacctgagcctccaacattcaaaaaggaaccacccaaagagaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaaattttaaggcctgaagtcaatattaaaaatatgagatatgagaaactgagttggctctgacaagtagtttttatagtgtcacaaatggttcatatatttcagtttccattttagctatttttgggacagaattttattttaatggaaaagatccttccactcagctactaaaataaggattaagaatatcccagagtaattggagtttttctttaaaaaaaaaaaaaaagtatgttttactgaggtatgatgattttgactacaactaaatgttatctattttagtgtttatgttaattaatgttaattaattttgtttatgttaatttgtgttaattaatgttactgtaatgttataaacataagaccaagtgttcttatagttatttaaaaactacaactactcaatggataaggaatagataaggtctccttattgtaccttttttttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccaggggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatgaaactaaataaaatctttactactgagccccaaatatgtatttgctatgcctgtctgtataatgtacttcatatagtttaaaatgcacttcagtgatacaaaatcccttttaaagactcttttgtttttgttttccctgtgtattttggctatcacaaaactagggttcttctgtttttaacttatgcatttaatgacacattgccatcttttagaattttttactattcaacagaataagctgatgtttggtggcagaggagttattagttgcgtgaactgtcaagagattgcagtgcaggagggcaacagaaactgtacaaggtgcagacttgagtcatgtaagatctatgtgaatgaaccaaagtaactagagtcagtcaagcacaaagctgtgaaaagtagtgtgtggaaagaatcatactgaattttaggaacaagtacctgactatgatactttttacagagtgactacaagttgtaggacagtctttgtgtgtgctgagtgtcaacagctgcctgcctatgtgttgatgttttcatcctttctttgttgaatgagggtataaccatcaaaaataaaatacctttcaaatagtc

SEQ ID NO: 1390 - DNA, 3468 bp, Homo sapiens
atgagtcagccaccaatcgggggcgctgcccctgccacagcagcagcttctcccgccgctgcagccactgaggctcgtctgcacccggagggcagcagcagaaagcagcagcgagctcagtcacccgctagaccgagggacagttcgctgcgacagacaatcgcggccacccggtccccagtgggggccggcactaaactcaattctgttcggcagcagcagctgcagcagcagcaacagcagggtaacaagaccgggagccgcacggggccgcccgccagcatccgaggaggcggaggtggggccgagaaggcgacgcccctggcgcccaaaggggccgctccgggagctgtccagcctgtggctggtgctgaagcggcccccgccgcgaccctggccgctttgggcggcaggaggcccggaccgcccgaggagccgcctcgggagctagagtccgtgccctcgaaactcggggaaccccctccgctcggagaagggggaggagggggcggggaaggaggaggagccggcggcggctccggggaaagggaggggggcgctccgcagccgccgccgcccaggggctggcgagggaaaggcgtacgcgctcagcagaggggcggcagcggcggggagggggcctccccttctccatcctcctcttctgcgggcaaaaccccaggaaccggcagcagaaactccggaagcggcgttgcggggggcggcagcggtggtggagggagctactggaaagaaggatgtctgcagtctgagctcatccagttccatctcaagaaggagcgggcggcagcggcggcggccgcggctcagatgcacgctaagaacggcggcggcagcagtagccgcagctccccggtgtctggcccccctgccgtttgcgagaccctggccgtcgcctccgcctccccaatggcggcggcggcggagggcccccagcagagcgcagagggcagcgcgagcggcgggggcatgcaggcggcagcgcccccttcgtcgcagccgcacccgcagcagctccaagagcaggaagaaatgcaagaggagatggagaagctgcgagaggaaaacgagactctcaagaacgagatcgatgagctgagaaccgagatggacgagatgagggacactttcttcgaggaggatgcctgtcaactgcaggaaatgcgccacgagttggagagagccaacaaaaactgccggatcctgcagtaccgcctccgcaaagccgagcgcaaaaggctccgctacgcccagaccggggaaatcgacggggagctgttgcgcagcctggagcaggacctcaaggttgcaaaggatgtatctgtgagacttcaccatgaattagaaaatgtggaagaaaagagaacaacaacagaagatgaaaatgagaaactgaggcaacagctcatagaagttgaaattgcaaagcaagctttacagaatgaactggaaaaaatgaaagagttatccttaaaaagaagaggaagcaaagatttgccaaaatctgaaaaaaaggctcaacagactcccacagaggaggacaatgaagatctgaagtgccagctgcagtttgttaaggaagaagccgctttgatgagaaagaaaatggccaagattgataaagaaaaggacagatttgaacacgagctccagaagtacagatccttttatggggatctggacagtcctttgcccaaaggagaagccggaggccctcccagcactagggaggccgagctcaagctacggctaaggctggtggaggaagaagccaacatcctgggcaggaaaatcgtcgaactggaggtggagaacagaggcctgaaggcggaactggacgaccttaggggcgatgacttcaacggctcggccaacccgctcatgagggagcagagcgaatccctgtcggagctgcggcagcacctgcagctggtggaagacgagacggagctgctgcggaggaacgtggccgacctggaggagcagaacaagcgcatcacggcggagctcaacaagtacaagtacaagtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaaagtgctaagatcattgatctttaccatgagaagaccattccagagaaagtgatagaatcttccccaaattaccccgatttaggacaaagtgaatttataaggacgaatcacaaagatggtctg

SEQ ID NO: 1391 - DNA, 709 bp, Homo sapiens
tctctgcacttcctggggagcgtctggcccagcttggtacctcgcgtgttagcctgctgagagctgcagctccagcccagccgcggaccgccgggaagtcacccgctctgggggcagctgaatcttgacgttaccgccattgtttggagaaatcgagtgggtgtggaactgcggcgagcgagcccaaagtcatgctcagccggaaagtcgcatacaataatatgaagttgaactttcctcggcgcagaaaggcacaataataaaccctgagatccccggaatatcagaaggaaagtgctgttgatttgttcagctacttggaaacctcgcctctgctgagaaattaaagaagctagtgacggatttatcttggaaatacacatactggaaattgatcttaccaccatgagggaagatgcaccagccttctgggttctgtctcagaattgctatataggaggaaatgggcactttaaaaagtacaacttttgcctatgatatgcgatgtaagaagatggctaagaatgaaaatattttctatctagcaattacacttaaaactaaagtgattcataagactacaaaactggcttaggaaggaaggttggcggcggtgaagagggaagaggatgatctagtaatgggctcttccaaatcgcatctggtaggttcatagccatgagtcagccaccaatcgggggcgctgccc

SEQ ID NO: 1392 - DNA, 4077 bp, Homo sapiens
ccgtgttcgagcggttttgggatcctctgccaagtacgggataagagaatagagcaaggagtttgagcgctgctgccaatcttccatctcgggcgtggctctggcctttttgtctctttatcccgccactccccacccccgtcccccgtccccctccccgccttcttctctttcctcttgaaagtaacctctctttggttacttctaccctatcgtcccttgcaatcccgccttctctcctgcccagttcggtgaggtcagctcatgaacatctctgcacttcctggggagcgtctggcccagcttggtacctcgcgtgttagcctgctgagagctgcagctccagcccagccgcggaccgccgggaagtcacccgctctgggggcagctgaatcttgacgttaccgccattgtttggagaaatcgagtgggtgtggaactgcggcgagcgagcccaaagtcatgctcagccggaaagtcgcatacaataatatgaagttgaactttcctcggcgcagaaaggcacaataataaaccctgagatccccggaatatcagaaggaaagtgctgttgatttgttcagctacttggaaacctcgcctctgctgagaagtgagcaagttctggatttctaaagggttggggatgaatgatgggcttaggaaggaaggttggcggcggtgaagagggaagaggatgatctagtaatgggctcttccaaatcgcatctggtaggttcatagccatgagtcagccaccaatcgggggcgctgcccctgccacagcagcagcttctcccgccgctgcagccactgaggctcgtctgcacccggagggcagcagcagaaagcagcagcgagctcagtcacccgctagaccgagggacagttcgctgcgacagacaatcgcggccacccggtccccagtgggggccggcactaaactcaattctgttcggcagcagcagctgcagcagcagcaacagcagggtaacaagaccgggagccgcacggggccgcccgccagcatccgaggaggcggaggtggggccgagaaggcgacgcccctggcgcccaaaggggccgctccgggagctgtccagcctgtggctggtgctgaagcggcccccgccgcgaccctggccgctttgggcggcaggaggcccggaccgcccgaggagccgcctcgggagctagagtccgtgccctcgaaactcggggaaccccctccgctcggagaagggggaggagggggcggggaaggaggaggagccggcggcggctccggggaaagggaggggggcgctccgcagccgccgccgcccaggggctggcgagggaaaggcgtacgcgctcagcagaggggcggcagcggcggggagggggcctccccttctccatcctcctcttctgcgggcaaaaccccaggaaccggcagcagaaactccggaagcggcgttgcggggggcggcagcggtggtggagggagctactggaaagaaggatgtctgcagtctgagctcatccagttccatctcaagaaggagcgggcggcagcggcggcggccgcggctcagatgcacgctaagaacggcggcggcagcagtagccgcagctccccggtgtctggcccccctgccgtttgcgagaccctggccgtcgcctccgcctccccaatggcggcggcggcggagggcccccagcagagcgcagagggcagcgcgagcggcgggggcatgcaggcggcagcgcccccttcgtcgcagccgcacccgcagcagctccaagagcaggaagaaatgcaagaggagatggagaagctgcgagaggaaaacgagactctcaagaacgagatcgatgagctgagaaccgagatggacgagatgagggacactttcttcgaggaggatgcctgtcaactgcaggaaatgcgccacgagttggagagagccaacaaaaactgccggatcctgcagtaccgcctccgcaaagccgagcgcaaaaggctccgctacgcccagaccggggaaatcgacggggagctgttgcgcagcctggagcaggacctcaaggttgcaaaggatgtatctgtgagacttcaccatgaattagaaaatgtggaagaaaagagaacaacaacagaagatgaaaatgagaaactgaggcaacagctcatagaagttgaaattgcaaagcaagctttacagaatgaactggaaaaaatgaaagagttatccttaaaaagaagaggaagcaaagatttgccaaaatctgaaaaaaaggctcaacagactcccacagaggaggacaatgaagatctgaagtgccagctgcagtttgttaaggaagaagccgctttgatgagaaagaaaatggccaagattgataaagaaaaggacagatttgaacacgagctccagaagtacagatccttttatggggatctggacagtcctttgcccaaaggagaagccggaggccctcccagcactagggaggccgagctcaagctacggctaaggctggtggaggaagaagccaacatcctgggcaggaaaatcgtcgaactggaggtggagaacagaggcctgaaggcggaactggacgaccttaggggcgatgacttcaacggctcggccaacccgctcatgagggagcagagcgaatccctgtcggagctgcggcagcacctgcagctggtggaagacgagacggagctgctgcggaggaacgtggccgacctggaggagcagaacaagcgcatcacggcggagctcaacaagtacaagtacaagtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggtaagaaagtgtgacatttttctgtatgaattgttttaatttttacttctttttttcatcctgtttgtctcctcttgataaataattggcatactgaatataaaaatggactacatgtctcataattatttctcagtagttcactattattattcaaaagctggacggacattcacaatttggtcacatttccaaaaagtatatacatttgtaaagtatctttgccaggttgcatcaaactaacaagataattttgacatccaataaatatctgaaaaaaaatatg

SEQ ID NO: 1393 - DNA, 11818 bp, Homo sapiens
agtgaacaaagagaactcccagcagccgccagccagctgcatcaggagatgttagtcacgcccggaaggctgttctagtccgcctccttggaaaagaagctcaagtaaataattgatggagaatgaccgaacccaggacaaagctttgcaggaaaccagtgcatccgtgttcgagcggttttgggatcctctgccaagtacgggataagagaatagagcaaggagtttgagcgctgctgccaatcttccatctcgggcgtggctctggcctttttgtctctttatcccgccactccccacccccgtcccccgtccccctccccgccttcttctctttcctcttgaaagtaacctctctttggttacttctaccctatcgtcccttgcaatcccgccttctctcctgcccagttcggtgaggtcagctcatgaacatctctgcacttcctggggagcgtctggcccagcttggtacctcgcgtgttagcctgctgagagctgcagctccagcccagccgcggaccgccgggaagtcacccgctctgggggcagctgaatcttgacgttaccgccattgtttggagaaatcgagtgggtgtggaactgcggcgagcgagcccaaagtcatgctcagccggaaagtcgcatacaataatatgaagttgaactttcctcggcgcagaaaggcacaataataaaccctgagatccccggaatatcagaaggaaagtgctgttgatttgttcagctacttggaaacctcgcctctgctgagaacttaggaaggaaggttggcggcggtgaagagggaagaggatgatctagtaatgggctcttccaaatcgcatctggtaggttcatagccatgagtcagccaccaatcgggggcgctgcccctgccacagcagcagcttctcccgccgctgcagccactgaggctcgtctgcacccggagggcagcagcagaaagcagcagcgagctcagtcacccgctagaccgagggacagttcgctgcgacagacaatcgcggccacccggtccccagtgggggccggcactaaactcaattctgttcggcagcagcagctgcagcagcagcaacagcagggtaacaagaccgggagccgcacggggccgcccgccagcatccgaggaggcggaggtggggccgagaaggcgacgcccctggcgcccaaaggggccgctccgggagctgtccagcctgtggctggtgctgaagcggcccccgccgcgaccctggccgctttgggcggcaggaggcccggaccgcccgaggagccgcctcgggagctagagtccgtgccctcgaaactcggggaaccccctccgctcggagaagggggaggagggggcggggaaggaggaggagccggcggcggctccggggaaagggaggggggcgctccgcagccgccgccgcccaggggctggcgagggaaaggcgtacgcgctcagcagaggggcggcagcggcggggagggggcctccccttctccatcctcctcttctgcgggcaaaaccccaggaaccggcagcagaaactccggaagcggcgttgcggggggcggcagcggtggtggagggagctactggaaagaaggatgtctgcagtctgagctcatccagttccatctcaagaaggagcgggcggcagcggcggcggccgcggctcagatgcacgctaagaacggcggcggcagcagtagccgcagctccccggtgtctggcccccctgccgtttgcgagaccctggccgtcgcctccgcctccccaatggcggcggcggcggagggcccccagcagagcgcagagggcagcgcgagcggcgggggcatgcaggcggcagcgcccccttcgtcgcagccgcacccgcagcagctccaagagcaggaagaaatgcaagaggagatggagaagctgcgagaggaaaacgagactctcaagaacgagatcgatgagctgagaaccgagatggacgagatgagggacactttcttcgaggaggatgcctgtcaactgcaggaaatgcgccacgagttggagagagccaacaaaaactgccggatcctgcagtaccgcctccgcaaagccgagcgcaaaaggctccgctacgcccagaccggggaaatcgacggggagctgttgcgcagcctggagcaggacctcaaggttgcaaaggatgtatctgtgagacttcaccatgaattagaaaatgtggaagaaaagagaacaacaacagaagatgaaaatgagaaactgaggcaacagctcatagaagttgaaattgcaaagcaagctttacagaatgaactggaaaaaatgaaagagttatccttaaaaagaagaggaagcaaagatttgccaaaatctgaaaaaaaggctcaacagactcccacagaggaggacaatgaagatctgaagtgccagctgcagtttgttaaggaagaagccgctttgatgagaaagaaaatggccaagattgataaagaaaaggacagatttgaacacgagctccagaagtacagatccttttatggggatctggacagtcctttgcccaaaggagaagccggaggccctcccagcactagggaggccgagctcaagctacggctaaggctggtggaggaagaagccaacatcctgggcaggaaaatcgtcgaactggaggtggagaacagaggcctgaaggcggaactggacgaccttaggggcgatgacttcaacggctcggccaacccgctcatgagggagcagagcgaatccctgtcggagctgcggcagcacctgcagctggtggaagacgagacggagctgctgcggaggaacgtggccgacctggaggagcagaacaagcgcatcacggcggagctcaacaagtacaagtacaagtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaaagtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaacaggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaaatgggatgcaaaaagaaactgaatgatgttgaattttagtttttctttaagttgtggtaagcttttagtttagctgctttaacatggagtcatacatacttagaggtaagtcatttattatttttttcctttttctaatcttttccttaaaattaatagataacaaactaagttacttttttactaacaaggaagatcaggaataatatttctttgaaagctgaaattatacttctcacagtttgctaccgaaaaaaggcttaaactaaaccttgacatccacagtagcatcaggaatagaaatgtgtattttggctacagtttgcatacagtgaacacataaaatctatattgaaaactgacagaaatatgaatgtcgaggggcttggaattctaaatggaagattttagaaggaactttgctctctactgtcactatataaaaccaattatgttatgttattagatattaactctatttaagcttttcttttactaagaaattcttatgccaaatgtattccaagagccatctccttatgatgtatttgaaccatttagagaaattcacttcattgtaccccatgacctgaggtaaagaaaataattttcaaattgcagacttccttgaaaggctcaagactgtagcatggtgatgtctagattcatactttactgtaaggacagtttcggtagttaagtggaattaaaggtctagagtgatttgtattggatggtaactaaggtctatacatctactcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtgtttgtgtcagtgtcacataagttctccatattgccttatgtcccaaagccaaatataaaaatataaatgatgctttgtataattcattttatcaaaaattacccataactttcatttgtttttatatcgacaatgaagatgatcatatttcattttgcagatgtggccataaaatattatttacttctatataggtgattttaccaggtttagttatcctgagaaaacatctggacttaagagtttctgcttccctacaaagatctttaaagttatttttaggcacatttgtgacaaacaactacttgatattgaaatctccttcagccattagaagctatcaaataaagtaggtgtaaaaacaactgtctgtggcatttgtatacatcgagaacatttttctttccctcattttctgcagtgaactccagtaaagctaagtgtcttatgaaatctaaactcatatatgtacacagttcactctagcttcttccaaaatatctctaggtagtacaactgaagccaaacctgcctgacttcctgctcctggccacccaaaactccatatggcttctcgtacactgacatcctctctctacccatttaactgctaattgagtctgataaaagtcttctttgaaaaaagtttttacttctaagatttgcatttacatcataaaattaaaccattttcaggaaaatcagatttttttattacagtactatttgctttaaattcggcatgtttttcttaagtagcaagtacatgtatcggaacttagaactggtgggcgcggtggctcttgcctgtaatcccagcactttgggaggccaaggtggggggatcacgaggtcaggagatggagaccatcctggtttcatcacggtgaaaccccctctctgctaaaaatacaaaaaattagccaggcattgtggtggtcacctgtagtcccagctgctcgggaggctgaggcaggagaatggcatgaacccgggaggcagagcttgcagtgagcagagatcgcgccactgcactccagcctgggtgacagagtgagactctgtctcaaaaaaaaaaaaaaaaaagaacttataactatgacttgttcatctcaccctgaaaatatgttcctacaagaaaatgtgctttgcaaagcaaaaaaggcaaaaattggggatgagttcttcagacaagtaccaaaaatgatttctcgtcatttttattgtatgcatattcatcatagaaaataattttttgttttattgggaataaaatcatgatacttaaaatctgatacacatttcaatgatagtattaatccaataggttaaattaacaaattcttaggaaaaaaatctgtttatatgaagctatggagaaatctagaaagtaggtaacggtttagattttgagggacctatgaactcagaacaagttcatttagaggtgggaaacctgagattcaaagaggtctgcatggctgccaagattgcagggacagaatccaagcctgggctcactcatgatctgctctcctgtataaatgtcccatgtgcatctatgaccttattgtttgcaaagcaaattcatattccacgacttgtctgcttcttacaacaaactacaaggcaggcattgtgatttctaagtaagaaggaaaaattaagtagtcaagataatatttagaataaatatttttgaagatgatagttaaatagatggctcttcagactcctagctcaggctatttttccagccttcttttcccaaggaagagaagacaaaaaaaaaaaaagattgaacagctctttttcatttttgttttgttcattttatacatgacacaaattgtttatcttgctctcattgggagtttctgttgattccctctttcaatgatcatcaaaagtcatcacccctgacttaaatggttttatgaaattcaagaagttgtgaacaaggctttaacaaaatatttccacttttaatgcctatgctctgattttatataaattttgtatgtaggacatgatgttgaagtaaaaccaataaatagccaatcagtattcatctctagcgtcaactgaatcctgacctcaatcttcaaaagaatcagaatagtttcacacttcataagttacatatactccagaataaataaaagcagtttgcttgaagtattatcttggctcatttgtgctgctataacaaaacacacttgagactgggttatttataaagaacagaaatttatttctctacagttctggaggctgggaagtccaagatcaagctgcaagcagattcggtgtctggtgagggctgctgtgtgctttcaaggtggtgccttattgctgtgtctttatatggcagaaggggccaacaatggagaaacagcagaatagcaagaagcagctgaatgctatgtgatgcttcttttataagggccttaaatcccattcatgaaagagaagccttcataatccaatcacctcctaaaggccctacctcttaatattgaagattaagtttcaacatgaattttggaggtacgtattcaaaccatagcaagcatacagtaatttccaatataaacctcactcaaaattacagtcacatgctgcacaaaccagttcaatgcacatatatgatgataagattataatacaatatttttgctatactttttctatgtttacatatacagatatcattgtgttacaattgcctttagtattcagtacagtaacatgctgtacaggtttgtagcctaggagcaatagatcatactttcaagcctaccatctagatttatataattacactctgtgatgttcgctcagtgatgaaatcacctgagaacacgtttctcagatcatatccctgttgttaagcaatgtgactgcaattgtgctctgctgccagtttatttttgaagctttatttttcaattacttactcatggcaattttataagaatcattaaacaaatttaatccagcta

SEQ ID NO: 1394 - DNA, 545 bp, Homo sapiens
cacggtgacaattgtgtcttcttccagatgtcatcgctataaggagtggggctttcatcacctccttgacgtaggatgtgtacatggctctccaggtcagagttgctccaagcaaggttgttttgcagaagtttcttctatgtgtcattcttttctacactgtgtactatgtgtccctgagcatgggctgcgtgatgtttgaggtgcatgagttgaatgtcctggctccatttgatttcaaaacaaatccctcatggctcaacataaactataaagttcttttagtttcaacagaggtcacctactttgtttgtggattgttttttgttccagttgtggaagaatgggtttgggattatgctatttcagtcactattcttcatgttgccatcacttcaactgttatgttggaattccccttgacatcacattggtgggctgctttaggtatatcaaaattgcttgtttagattctctaatgcacagaaataatgttaaatagaataactgtggaaatatattttattttctcatagattttacaa

SEQ ID NO: 1395 - DNA, 568 bp, Homo sapiens
gtttctaatttaagtatgagacagtaattactcatacagccagagaggattccaagtccctgcctatttgccgcactatctaaaaacaatcaactcatctttcaaatctgaccaaactacaaatgatgtcatcgctataaggagtggggctttcatcacctccttgacgtaggatgtgtacatggctctccaggtcagagttgctccaagcaaggttgttttgcagaagtttcttctatgtgtcattcttttctacactgtgtactatgtgtccctgagcatgggctgcgtgatgtttgaggtgcatgagttgaatgtcctggctccatttgatttcaaaacaaatccctcatggctcaacataaactataaagttcttttagtttcaacagaggtcacctactttgtttgtggattgttttttgttccagttgtggaagaatgggtttgggattatgctatttcagtcactattcttcatgttgccatcacttcaactgttatgttggaattccccttgacatcacattggtgggctgctttaggtatatcaaaattgcttgtttag

SEQ ID NO: 1396 - DNA, 900 bp, Homo sapiens
agcctggaggcctgcagtccgcgcggccgcggggagggacgagagggcctgacgtacagattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaacacttttttataatattttctcactgagactcccagggcttttactatctccagaatgtatttttcctttttccgtaagactcaaaagtaatataaggtctacaaaatctactaaaaagtctctgcaaaaagtagatgaagaggactctgatgaagaaagccatcatgatgagatgagtgagcaggaagaggagcttgaggatgatcctactgtagtcaaaaactataaagacctggaaaaagcagttcagtcttttcggtatgatgttgtcctgaagacggggctagatattgggagaaacaaagtggaagatgctttctacaaaggtgaactcaggctgaatgaggaaaaattatggaagaaaagcagaacggtgaaagtgggagatacattggatcttctcattggagaggataaagaagcaggaacagagacagttatgcggattctcttgaaaaaagtgtttgaagagaagactgaaagtgaaaaatacagagtggtgttacggcggtggaaaagtttaaagttgcctaagaagagaatgtctaaataaatggattgctttttagcaatagagctgctttctagtggtaaaggaaggggtcacctgaaaaataggacatttttattaaaataaagttctcttagcgtttgtggaa

SEQ ID NO: 1397 - DNA, 1434 bp, Homo sapiens
agataggggtagcctggaggcctgcagtccgcgcggccgcggggagggacgagagggcctgacgtacaggtgagtgcgcctctgctggcgcgccgcgccgggccccctgcccgcgccccctgtcacttcgcctctccgccccgcccacgctcccgccgggtctccccgtgagtgtcccgtgtcctgccagcctcgggacgccccgcgagctcagggctgcgcagggactgtggtaattgagcgcggcgaagccttccgttcctgcctcctgtcgctcctgctggctccgaatgcagactgcgaacccggggacgcagttgtccatttcctttgaccttggggacccaggaaggtgcactgcccgcgggggtggggagggagcgagaggaatccgaccctgtctcagcccacagcctccgaggtctccaagtaaagggaaggatctttagctgcattagacttcaaagcgtttagaccagtttctccatcttacggagcggtgaacgggctcaggaatgtggagcgtttcctggcgtcaagcaggtcaaagtcagcgctgctttttttacagacactgcttttcttacagtcttcgattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaacacttttttataatattttctcactgagactcccagggcttttactatctccagaatgtatttttcctttttccgtaagactcaaaagtaatataaggtctacaaaatctactaaaaagtctctgcaaaaagtagatgaagaggactctgatgaagaaagccatcatgatgagatgagtgagcaggaagaggagcttgaggatgatcctactgtagtcaaaaactataaagacctggaaaaagcagttcagtcttttcggtatgatgttgtcctgaagacggggctagatattgggagaaacaaagtggaagatgctttctacaaaggtgaactcaggctgaatgaggaaaaattatggaagaaaagcagaacggtgaaagtgggagatacattggatcttctcattggagaggataaagaagcaggaacagagacagttatgcggattctcttgaaaaaagtgtttgaagagaagactgaaagtgaaaaatacagagtggtgttacggcggtggaaaagtttaaagttgcctaagaagagaatgtctaaataaatggattgctttttagcaatagagctgctttctagtggtaaaggaaggggtcacctgaaaaataggacatttttattaaaataaagttctcttagcgtttgtgg

SEQ ID NO: 1398 - DNA, 1517 bp, Homo sapiens
agataggggtagcctggaggcctgcagtccgcgcggccgcggggagggacgagagggcctgacgtacaggtgagtgcgcctctgctggcgcgccgcgccgggccccctgcccgcgccccctgtcacttcgcctctccgccccgcccacgctcccgccgggtctccccgtgagtgtcccgtgtcctgccagcctcgggacgccccgcgagctcagggctgcgcagggactgtggtaattgagcgcggcgaagccttccgttcctgcctcctgtcgctcctgctggctccgaatgcagactgcgaacccggggacgcagttgtccatttcctttgaccttggggacccaggaaggtgcactgcccgcgggggtggggagggagcgagaggaatccgaccctgtctcagcccacagcctccgaggtctccaagtaaagggaaggatctttagctgcattagacttcaaagcgtttagaccagtttctccatcttacggagcggtgaacgggctcaggaatgtggagcgtttcctggcgtcaagcaggtcaaagtcagcgctgctttttttacagacactgcttttcttacagtcttcgactataaactctacaagaataggaatcttcgtatttttttcctctgctgaattcctagtgcccagattagtgcttggcacatgattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaacacttttttataatattttctcactgagactcccagggcttttactatctccagaatgtatttttcctttttccgtaagactcaaaagtaatataaggtctacaaaatctactaaaaagtctctgcaaaaagtagatgaagaggactctgatgaagaaagccatcatgatgagatgagtgagcaggaagaggagcttgaggatgatcctactgtagtcaaaaactataaagacctggaaaaagcagttcagtcttttcggtatgatgttgtcctgaagacggggctagatattgggagaaacaaagtggaagatgctttctacaaaggtgaactcaggctgaatgaggaaaaattatggaagaaaagcagaacggtgaaagtgggagatacattggatcttctcattggagaggataaagaagcaggaacagagacagttatgcggattctcttgaaaaaagtgtttgaagagaagactgaaagtgaaaaatacagagtggtgttacggcggtggaaaagtttaaagttgcctaagaagagaatgtctaaataaatggattgctttttagcaatagagctgctttctagtggtaaaggaaggggtcacctgaaaaataggacatttttattaaaataaagttctcttagcgtttgtgg

SEQ ID NO: 1399 - DNA, 613 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttga

SEQ ID NO: 1400 - DNA, 668 bp, Homo sapiens
accacatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttga

SEQ ID NO: 1401 - DNA, 833 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtataga

SEQ ID NO: 1402 - DNA, 2396 bp, Homo sapiens
acatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcgcaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaatgaa

SEQ ID NO: 1403 - DNA, 910 bp, Homo sapiens
cgctgattcgctcgcagcttctcctcaccacatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctctgtcccccccacatagctccacttgtgaaaaccgagccccagaggccagtaaaggaggaagagcccaagattccaggggacctggaccaggaaccggtaagggcatggggatgggaaggggatagccagaatctctgaggaaaatggaccaaaaaaaaaaaggcctgaaccccaaggaagactgtggagaccatcttgtcttcctccccttcctcctccagagcctgctctatgcggatctggaccatctagccctcagcaggccccgccggctgtccacagcggaccctgctgatgcctccaccatctatgcagttgtagtttga

SEQ ID NO: 1404 - DNA, 594 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttga

SEQ ID NO: 1405 - DNA, 2230 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1406 - DNA, 2290 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1407 - DNA, 2392 bp, Homo sapiens
acatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1408 - DNA, 2249 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1409 - DNA, 2362 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1410 - DNA, 2362 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1411 - DNA, 2230 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1412 - DNA, 2249 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1413 - DNA, 2290 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1414 - DNA, 2249 bp, Homo sapiens; identical to SEQ ID NO: 1412

SEQ ID NO: 1415 - DNA, 2392 bp, Homo sapiens
acatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1416 - DNA, 2392 bp, Homo sapiens; identical to SEQ ID NO: 1415

SEQ ID NO: 1417 - DNA, 2230 bp, Homo sapiens; identical to SEQ ID NO: 1411

SEQ ID NO: 1418 - DNA, 2290 bp, Homo sapiens; identical to SEQ ID NO: 1413

SEQ ID NO: 1419 - DNA, 2362 bp, Homo sapiens; identical to SEQ ID NO: 1410

SEQ ID NO: 1420 - DNA, 2249 bp, Homo sapiens; identical to SEQ ID NO: 1412

SEQ ID NO: 1421 - DNA, 2249 bp, Homo sapiens; identical to SEQ ID NO: 1412

SEQ ID NO: 1422 - DNA, 2392 bp, Homo sapiens; identical to SEQ ID NO: 1415

SEQ ID NO: 1423 - DNA, 2290 bp, Homo sapiens; identical to SEQ ID NO: 1413

SEQ ID NO: 1424 - DNA, 2362 bp, Homo sapiens; identical to SEQ ID NO: 1410

SEQ ID NO: 1425 - DNA, 2230 bp, Homo sapiens; identical to SEQ ID NO: 1411

SEQ ID NO: 1426 - DNA, 2392 bp, Homo sapiens; identical to SEQ ID NO: 1415

SEQ ID NO: 1427 - DNA, 2230 bp, Homo sapiens; identical to SEQ ID NO: 1411

SEQ ID NO: 1428 - DNA, 2290 bp, Homo sapiens; identical to SEQ ID NO: 1413

SEQ ID NO: 1429 - DNA, 2362 bp, Homo sapiens; identical to SEQ ID NO: 1410

SEQ ID NO: 1430 - DNA, 2206 bp, Homo sapiens
attgattcatttaatctgcatgttggcggtgtgaatagtagaaaactcacagttgaaaatgcctcttgtcagccacggagcgcacaggcatttgtgtgcgtaaccccgggtagcgttcatgtgcacctaaagtgtgacgacagcctatgggaaaccaagggaagggtcacctgtagaggtccggacattcggttttgcctttaagacaactattagatcctaagcgactgtgttgtggctgagttaaaaatgtgcctgtttacttgcagagcttcttccattaggtgaacaatctgttgtgattttaatgtgtaagacctttggtaatgtgaggaattgattagatagtgcagcccagtctctagaggatcagatctgtgggattggttggggtggttgggcaaagtccatggtgagttaagaaatgactttggaagtgactctaatgtgtacacaaacaacacacatgcacacaccacacatacatacacacacgaacacatacctccatgctgcatatacacacacaggcatacacacactctaatgtgtacacaaacacacatgcacataccacacatacacacacacacatgaacacatacctccatgccacacagacacacacaggcatacacatactctaatgtgtacacaacacacatgcacacaccacacacgaactcacacatccatgccacatatacacacacaggcatacacacatgcaggcacatacactacacacacacacacacacacacacaggcacagttgcatataaacacacaaatgtacacacccccacaccacatatgcacatacacatatacacaccacacatattcatagtcacatacacaaacacacatgtgtatacaattattaatatagtcttaaagtcattctgttggttaagaaaatatttcctgaacacctgtttgctgaattttaaagactgtccatttaatttgcttagaccttagataacaagttaggctaaaagtactatatccatcaactctgaaagttctgtatgtttatgtatggggaccagttaaccaatgtatttatttttgatgttttagatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacag

SEQ ID NO: 1431 - DNA, 2000 bp, Homo sapiens
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacaccaaccagcgatacgccgctagccctggctcccagaaagccgcagccttgcaggtgcagaaggagagtgaggcccagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacag

SEQ ID NO: 1432 - DNA, 2141 bp, Homo sapiens
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacag

SEQ ID NO: 1433 - DNA, 1908 bp, Homo sapiens
attcacgcgcgccgcagcggggcaccggaagttatggagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttg

SEQ ID NO: 1434 - DNA, 1859 bp, Homo sapiens
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagactatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgt

SEQ ID NO: 1435 - DNA, 2024 bp, Homo sapiens
cccgcccctccccgtctctccccgcccctccccgtccctcccgccgaagctccgtcccgcccgcgggccggctccgccctcacctcccggccgcggctgccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggacggcatcagaattaatgtaactacactgaaagatgatggggacatatctaaacagcaggttgttcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatataaggtaatgtgtcagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaaaggaattcttcagttggataaagtggacgtcatacctgtgacagctatcaacttatatccagatggtccagagaaaagagctgaaaaccttgaagataaaacatgtatttaaaacgccatctcatatcatggactccgaagtagcctgttgcctccaaatttgccacttgaatataattttctttaaatcgttaagaatcagtttatacactagagaaattgctaaactctaagactgcctgaaaattgacctttacagtgccaagttaaagtttaccttattctcggccgggtgcagtggctcatgcctgtaatcccaggactttgggaggccaatgcgggcggatcacgaggtcagatcaagaccatcctgccaacatggtgaaaccctgtctctactaaaaaaaataaaaaaattagctgggtgtggcggtgcacgcctgtagtcccagctacttgggaggctgaggcaggagaattgcttgaacccgggaggcggaggctgcagtgagccaagatcacgccactgcactccagcctgggtgacagagcgagactctgtttcaaaaaaaaaaaagttgaccttattctctaaaagggctggctattcatatgatgaattgttaaggaaaacttaaagtggaagagaacacatgtgaagagactttgaaattatcaaaagaaaaaaaaaagaccagacaaaatctcatgtgccaataacttttcaaggtgcctttgttaaggaaattatatccacttaattactataatatataagactttatgaaaagcactttataaaattctaatttaaaaggtcaagaacttaacacttatttttttattcagtacagtgtgcctttatattaagtatgtgactcagtataaaatcactgaagtgtatcatgatttgattgtatcctgtaccaagactacttaccttgaatgctccaagatttaaaagtagtatgacatgttctcactctaaaataaactttttttttttttttttgaggaaaaaa

SEQ ID NO: 1436 - DNA, 897 bp, Homo sapiens
ccggggaggggagggcccgtcccgcccctccccgtctctccccgcccctccccgtccctcccgccgaagctccgtcccgcccgcgggccggctccgccctcacctcccggccgcggctgccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggacggcatcagaattaatgtaactacactgaaagatgatggggacatatctaaacagcaggttgttcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatataaggtactggaaacagttgactctgctccatttcgtttataa

SEQ ID NO: 1437 - DNA, 563 bp, Homo sapiens
ttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatataaggtactggaaacagttgactctgctccatttcgtttataatggactagcctaacgaatctcttgtcaattagcaattattttcacttgatttgtagttagaaaacaatataaataattttacaggctattaacatttttgtgcttgtattgttagaacataatttttaaagttgtaagtaacttcattgaggtacattctaaaataaaatcaccatttaaaatat

SEQ ID NO: 1438 - DNA, 1309 bp, Homo sapiens
gaagcgctggacgagaggaggaattactctagggtacaaggcctcgcccaggagtggggggttgcttccgggtcgcgctcccggaaacaggaagttgcccatcctcctcgcccggcggcagctgtccccgaggcgggaggagcccgaggggcgcgagccccgcatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaa

SEQ ID NO: 1439 - DNA, 2565 bp, Homo sapiens
atgctgcagagggagaggacaacagctccagtaaacaaaaaggtcagggcagacaggagtattatggaactgctccaggactcttgattttcaagcttatggtgtcaggaatgggatctaaagtggagcttctagcgacccccaggagcactgagtgaacatgcaaggtacctgcaggatccacttgtgtctattgatctctcacagcagctggggatcacagaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctg

SEQ ID NO: 1440 - DNA, 1400 bp, Homo sapiens
gaagcgctggacgagaggaggaattactctagggtacaaggcctcgcccaggagtggggggttgcttccgggtcgcgctcccggaaacaggaagttgcccatcctcctcgcccggcggcagctgtccccgaggcgggaggagcccgaggggcgcgagccccgcatgtctatgccactgttagaatcaggctaactcttcagaacttccccctgtagcaaagctcactttggccagagttggaactactttctgcagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaa

SEQ ID NO: 1441 - DNA, 821 bp, Homo sapiens
aggagtggggggttgcttccgggtcgcgctcccggaaacaggaagttgcccatcctcctcgcccggcggcagctgtccccgaggcgggaggagcccgaggggcgcgagccccgcatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaaggaaatagaactgtgcacaggaacagcttccagagccgaaaaccaggttgaaaggggaaaaataaaaacaaaaacgatgaaactgctttctgggggttggttacttagttacctgccctttgcatgcatgtg

SEQ ID NO: 1442 - DNA, 1476 bp, Homo sapiens
atgctgcagagggagaggacaacagctccagtaaacaaaaaggtcagggcagacaggagtattatggaactgctccaggactcttgattttcaagcttatggtgtcaggaatgggatctaaagtggagcttctagcgacccccaggagcactgagtgaacatgcaaggtacctgcaggatccacttgtgtctattgatctctcacagcagctggggatcacagaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactg

SEQ ID NO: 1443 - DNA, 839 bp, Homo sapiens
gaggcgggaggagcccgaggggcgcgagccccgcatgaatcattgtagtcaatcattttccagttctcagccgctcagttgtgatcaagggacacgtggtttccgaactgccagctcagaataggaaaataacttgggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaaggaaatagaactgtgcacaggaacagcttccagagccgaaaaccaggttgaaaggggaaaaataaaaacaaaaacgatgaaactgctttctgggggttggttacttagttacctgccctttgcatgcatg

SEQ ID NO: 1444 - DNA, 2292 bp, Homo sapiens
atgctcgccagccccgcccggcccacattgcgcatgcttgccaaccacgccctgtccacaccacactgcgcatgctcgccggcccccgccccgcgcacggcgtcagcgtctagacgcaggtgcgttcccgtcgaggctcgcgcagcgggcgtttttggggatcgcctggcgggggtgttcgggagccgcgggctgaagcacgggggcgtgcaggcgcccaggcctcgtgtagtgagggccgagccccgcgccggcttcgctgtagtccgcagcccccggcggctttgtgggcgcagccacgctcctcagccgcccgcccacctgggcctgggccccggttgtttccctgcggtggctgtggtcgttcccgttccagggtctcgagcgcaccgccccttcgctgcgctgttagtcgagggcagttttctgggggatcccccgatccccccgcgccgctcaggcgtcttggctcgcggaagcgcaggcgccgactgcctggcgtcgtccgtgactcctggcccttctctgtggatccctttgcttctcgttgcgggttgtgtttcctgcttcgtgggcctggccgtttgcgtttggatgcaggcccgggtgagccctgcgtggcccgctggccttttcctgctccctaggtgactgagccgcgtgtgtgacacatcggagtgaattgaggcaacgcgttcctttccaggcttgcagcgggcggtgtcgttcacgctcctgagcagagccttccggtgctttactcgacgccacaaatagtgcagggttcctcccaggggctgtcgcgagctagaactcttccccgcccctgtgagctcgggctgttcttcctcctccgcgtggctcactccagcctcggatgtttcctcgctgcacagacctgctcgggaagactcgagaaggccaccccaggactccagctctccccggaagggcttcccctcggattgcgtcttggcccctggaaccctccctctgtatcctctgctgttcctctcttggcctccatttgggttgtggcctggatactctggctcgctgcttcccttctcttaaggatcacagccctgcactgcctgtcgtccggtgcctggaaaccattgtattttttggtctgattttgtagttgtttgagaacttaagtctggtccctcacactccatgcccagaagcagaaatgagtaaagtttgttttatcttttcttaatatgacaattattgtgttggttcaacttatgttgtactttaattagaagaaatttggccgaaaatacaaggaaaatatacaaatgcaagtaattttttttaaacttccctgaaagcagggtctaaagaaattaccaaccaacttagactggatctagaagaaaaggaagggtctttgcagtcttaggactcttccgttccgcgacgtaggtgttaggataacagccataaatggttgtaagactttgggctcagataagtagacttaagttcaaattttgacttattttacaagtgtgtgatttttggcaagctcatcttcctaaaccatgagctccttatttgtaaaggggacattagccactctccagcaacagccctggtacttcttcagtcctgggatgggacgtatgattagcctaagcgaaccagaaaatccaggcccgtgaccagtgacttgatcagggctggcgatatatctaggtaggccaaccaggtggactcagtatttttgtgggtgctactggaaaatttatttaattctaactgaatgtagaaacagcaacagacatgaaatggcagttgtattgctgtcttatcatgaggtgagggcctgaagctatggtagccaccctgtgaaccttggaaggagggttctacaggaactggcagagctgagactgggacgcaacccatgtcctggtgacgtatttgagtcctgaggctggccctcctgttagtcttttctcttactggcttcagccagatggggtctggttttctgttacttgcaacaggaaaaattggaatgatatctatgcatgctattaccgccttatggctgtggtgagattaaaacatgatactgtgggtgaactgcttagtacagtgcctgctattctttatgttggttttaaggtatttttcttgaactttaaagttctaagaaaaattaccgttttaaaattcctaccctctgttcacatgtttaaattttcatgatagtttttctgtctgcatgttttctattcaaaataaattggtcattcttcagttagccacgaagaa

SEQ ID NO: 1445 - DNA, 1061 bp, Homo sapiens
cacttcctgcggcagctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataatttatacaa

SEQ ID NO: 1446 - DNA, 1273 bp, Homo sapiens
gggcgggccgacttgcgacggaggcagcgggtccgggtcgggggacctgagaaggagccgggaggtgatccgcagcgctgcgacgggaccgcgcgattcctctcccacgcatctggcccgcgttcctgggcctcggcaccggatcccggcgggggtgtggacccagggcccactctccccggcgcggccagggccccccagcgtgcgagcgcctaggggatgccgagctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataatttatacaa

SEQ ID NO: 1447 - DNA, 544 bp, Homo sapiens
ccgggaggtgatccgcagcgctgcgacgggaccgcgcgattcctctcccacgcatctggcccgcgttcctgggcctcggcaccggatcccggcgggggtgtggacccagggcccactctccccggcgcggccagggccccccagcgtgcgagcgcctaggggatgccgaggtttggcgggcgcgggaccaatatgggcagggccgaggcgggattctccctctcgctgtgcctagaccgtactcctgctgcagttccggcagagagcgcggggagagcagcggcgggagctgcggcgagcacgccggccctgggctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgct

SEQ ID NO: 1448 - DNA, 3044 bp, Homo sapiens
agctcttccgggtcactgcagtcttcacgggctccagactccgcccatggtccgtccttcaggccttgactccgcccacgcatcgacgtagaatttcccggccgggctccatgaagtaccacccacccgcgacgccgacgcaaggctgctgctatggggccgggcggccgtgtggcgcggctgctcgccccactaatgtggcgcagggcggtttcctcggtggcggggtccgcggttggagccgagcccgggcttcggctgctggccgtgcagcggcttcccgtaggagcagcgttctgccgggcttgccagaccccaaactttgtccgcggcctgcacagcgagcctgggctggaggagcgggcggaggggacggtcaacgagggacgcccagaatcggacgcggcagatcatactggtcccaagtttgacatcgatatgatggtttcacttctgaggcaagaaaatgcaagagacatttgtgtgatccaggttcctccagaaatgagatatacagattactttgtgattgttagtggaacttctacccgacacttacatgccatggccttctacgttgtgaaaatgtacaaacacctgaaatgtaaacgtgaccctcatgttaagatagaagggaaggacactgatgactggctgtgcgtggattttggcagcatggtgattcatttgatgcttccagaaaccagagaaatctatgaattagagaaattatggaccctacgttcttatgatgaccagttagctcagatagcacctgagacagtacctgaagacttcattcttggaatagaagatgatacttcatctgtgactccagtggagttaaaatgtgaataaaatattttatgcactgcgttagtcatttcagatttggattgagtcacttattggaaaatacagctcctaaagtccgtctccttggttaggctgctcttaggacaaggcttgtgtacctcatgggcactcctgctaactggcatgcagagactgtcgataagtgagctatacctgcaaccaaaaatcagtacattctacccaaaacttatgacacgctgcctttatcctggaaatgtcatcagaatttcctggagttagcactggctcctgtgcttgacttctctgctcagatttttattaatttaatttagcttaaatgtaaatcttaaccctgtttgtttaatggaatggcaaaaattttaaaaaataatataaaacatagcccactggtcttatttttatactttgaggtgataatattcttctaggaggacttctgtaacccttccagaatactccagtaacacaagaaagtaaacaaagtgtttgttaggaaaaactctgaacgctctagttcttagttcatatgcaagagtattatcaaggttcacattaagtaccatggctggacatggtataacagaaatctgcgtagagtttgaaaaaaaattcagaacattcccattcaattgaaaaccaaaaataaaacatactacacaacaagctgcacctaaatgatgaaaaaatttattctgcgtcaaggtatctggaaaatgaagctgcatttggggcacattatacatgaggaatgatccatatatggtgagtacaaaactcaattatagaattatttcttagctagtaccagatactccaaattacaaatgcttaagtaaaagtaaaatatgatttgccatactaaaaggctagaagtgaaatatgacagaatttaaaccagcagatataaatgcagcacctatgtgtatatttttaaaaaatcaaatattggggaaaaaaatcaaatactgagaaaagctctggccttaaacacatcttacctgaaatccaaccagaaagccagtccatgattttagcaattttaattcattgtatgaaaaaaaaatcatgaatgctaggagaatccagtgacaaaaagggcacttttttggttaaaactacaaaagaaacttgttttcagagaacattaaggaaaacactttaaatcattttcaaaatgtctaattgatcttcagaaaaacatctagtctgtatagaaattcatcttgaaataagaatgaggcagtgattttttttttaaagggttatatatatgtcctttagatcagtgtaacatgactgtgatcatcttacaaacaaaactcaaaaaatcaattcagagagcagcgtggccttggagaccacccacacccaacacaattgtacgtactgggctttgctgtcaaggagtgagcaaatgagttcgttatcaaaggtcatatgttttcacagtcattcaaattatatcccaaaaacttttcttgtattctctatcttttgacttttttttcaaagaactgattgcacagtatacagaaatcctgttatactttactacttaaggtggagtctaattttttttttttaatttatcagtgcttaaaaatcttcaaaatagcttagtgaggctcatgacagtgctggccccatggaaatgtagccttttgttgcgtttaaacactgtcacaccatctatgactgtcccattggtctgaagtgtagtggcaaactaagcatcctataagacaagctaaagcttgctttttgccagtcagttgaaagtcttgcatctcttcactgatgcactttctttaggtattgatagtcagaagcacaaagcatttattatgcattcaatcatgtagctaaacaaaaaactgaagtctcctgaagccatttaaaccagccgttccaaaatctcctgcgaccactttgttagtaccgtcaaaaactttcccaactataaatgaaagaataaatggtagtgctgctctccagatactaggcactgctccgtatttttgaacatttgatttaactaataactgtgtcaaaagcctcaaaaaaccctgaaattaattttccagctttactgtcaccagccagaagtaaaaatcttaatttgcctgttagctgattgctgttaaattttaaatttattttttaaaaaacggttggacttctatcat

SEQ ID NO: 1449 - DNA, 4229 bp, Homo sapiens
acccggaaaccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtttgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 1450 - DNA, 637 bp, Homo sapiens
agaaaggtgggagggagagactcacgtacgtccacaaagttaaatggcatagtggtgttccctgtgtcaagcttggtaaatatccggaatggggtggattctttcttcatgtttttaataaaatgaggagtgatcgcaaggtaatctagaggcatgtagtttcagttcccttgatggggaccatcagaaataaaaccaggcttgttgtgctgttttgagtcgtttgaacgccgtacccatcggacagctggtgaggaggcctttgtggaagaatctgatgtctgagtttagttctcaactagcaggtgacagccctcactggctgatgaatggtgagcttctctgaagcctgctttgtaaagattgtggcttccgcctgaactgcttctttcctgcctcaaaggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaat

SEQ ID NO: 1451 - DNA, 545 bp, Homo sapiens
gcactgctttgcggtggggcaggaagatggtttctgcgcagtgcttggggcagctgggtgctggagcttgcacagggtttctttgataccagtaagtgtcttcagctctaagtgttggataatctggcatcgcatcgatgactgttgtttactaggctcagggtttgtaaccccggccttaaagctctttgagggtctcagacatcacaggatatttgagaaatgctactttctgctacatgaaggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcc

SEQ ID NO: 1452 - DNA, 536 bp, Homo sapiens
attctgcctgcactgctttgcggtggggcaggaagatggtttctgcgcagtgcttggggcagctgggtgctggagcttgcacagggtttctttgataccagtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaacca

SEQ ID NO: 1453 - DNA, 857 bp, Homo sapiens
caagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacaaatgctatttgtcatttttaaactgaatccgaaagaaactcctattataaatttaagataatgtaatgtatttgaaagtgctttgtataaaaaagcacatgataaaaggaatcagaattaataaaatgtttgttgatc

SEQ ID NO: 1454 - DNA, 1085 bp, Homo sapiens
tttcccaagcctggaagaactcgtcatgctctttgtagcgtggtgcttctgttgctcacaggatgtttgccacacgagtcactcgagagaatctctgagtcctggcgagggctttctgaggcttcgtgtgttagcagctgttgtcttccaactcagcggcaggtttgcctttccccacggacactctggaccttgtagctcctcaagcttccctgtctattgagcagataggaagccgtgtcaaatatgtggcaccttgaggaaatgcctagtgaatgacagacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacaaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 1455 - DNA, 2448 bp, Homo sapiens
acccttttgcggcacacttgctaccttggtcttagctctgggctttggtgtcctctggcagtcctgctgcattgccttctctcccccatctgcccacccctgtcccagagagatttttctgtagcccctcatctgcagagtccgacagctcagggtcgagggtctttcttagcagtaatcacccactatgctctcacccctccatttctggacatgcttcctgtggcttctctcctgcgctttacacttcagcagttcttgtttctgctcactctgcctttgtttgtcatttcctggatttgaagctgttctgctcttttcacctttctcttctcaaggtaaacttcctctgtgaaacctccgctgatgccctgcagcaaggttgaccacttcctgagtgttacttcctctcttggtgcatatgtctggttgcactaaccaggctgctgctagcccaaaggcacctttgtgcaaattagaaaaagacaaccatccccatcccttcttcaagatactttatagtacttccaactgttggcaaactgtcttaataaagatacaaatctttgatttctctaatgtgcatggtgccctacaagggttgtgcagtgcatagccgtgcagttgcatgtgatagatctatgttataattatttgtttaattgtctgtattcccctcaggaccaaggaaaattccttatatcttgatactgtttttatattcttactgtctgaccagatcagaccctcagtaaccgtttgctaaacaaaagaaggaatgaaggtacaaatatgtatccaccttgtctggaaaaatagcaggaaaggcatgcctgccaaggacttttacactgaacagtaagaatatattttagctcagagacactgtttgttttcacatttcaatattgctttaattagatatcttaaagctcgtgtaccacagtggttgaaagagcagatgctggagccagactgcatgaatttgaatcccagttctaccacttattcacttattagtgcacctttgggcatgttacttaacctttctgtgcctcagtttactcatctgcaaaatgagcgtgatgataatagttcctacttcaaagggttgtgagaattaaatgaattatataaagtgcttagaatagtacaagacacataatagtcagagacagaagtattaggtattatcaatattgttaaagtccatgtataagtttactgtactattgtttctttttaactctgaagtgctgttttcactctgtcacgtacagcttttattgctagcatcttgcttctgcaggtccagcctcctgttgattggccctgtgtttgtgctgtggtcaaagcacttgctgtctgcggttctcccttgtgcacaccggttctttggttgctgtaacaaaaactacataggacacagacaggaaacccgcaggctttgttttttcttcctaatttggcagcagaagggggaaaaaccagggcctttcacagacaaggcttgttttagagtttaattttaacttcttgttcgtgttctaaagcttgggttggtaataaatcttggctgtatgagactagagagaactgggctttaaaaatatgattttaatgtaaaatcttttctaattgcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacaaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 1456 - DNA, 893 bp, Homo sapiens
gcgtggtgcttctgttgctcacagaggtgcctgcttccccttctgccatgattggaagtttcctgaggcctccccagccatgtggaactgacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacaaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 1457 - DNA, 1709 bp, Homo sapiens
aggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatgaaacacaactggttttgagaatccatcccttcttcactcagtccacgtaaaggttaggatggtagaaagtgttatacctcttcctccagagttggagcctatgacactgatgacactggcatggaaagccaaagccctacaccaaccagcacacttactggttccaaattgatctacgctggtgtaatcagagtgaatctcagaactttggacagagctgtgagcagagactgactttcctgctgtctccaggtagctgcaaggctgaacagcagcacctactttattaccatcttactgtcattcaaagaaggcagagctgaatgctggagaaaaactgagtactagcaacagtttttgaaccctgaatactgtcataactgaagctagaattatccctggacttgtttgccactaaaatttccttgttttgcttaccctggtttcagctggcaccctgatcacttgaaaggaacataactgatatactgtcctttgtttttctttccttcctcttctccgcctttgatgattttaaattagaaatctacctgcctctaatctctttaattttctcatttatttactgctgcctattttccaaaacactgcttctcgaatattcctggctcaaaaatcatctatgtcttcatgacatatgaaacccctagaatccagcctttccccagcttttaatatctcctaattgatttctcaattccagtgaaatgattccatttatttttttcccaaacacatcacaaatattcctaactcttgtgagcaattttctctcattcttctcaacttatctaaatcctaacttttcaaaagatctagctcaagttctgtcttatcatattttgagttcctttctttggcattgtattattttgtatctttccatgtacacatgtgtgcattatctccctgataaaactaactggctagaggataggagtaaagactcaattctaatatccttgttacctaataatacacaaacgtgaaa

SEQ ID NO: 1458 - DNA, 524 bp, Homo sapiens
gctggcgcgcaggaccgcgggcatttacccgtgctttcccaagcctggaagaactcgtcatgctctttgtagcgtggtgcttctgttgctcacagagtctcgctctggccagagattttctaaataatggtcaggaatctgcattgacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagag

SEQ ID NO: 1459 - DNA, 720 bp, Homo sapiens
gggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactagtggttcagatttactttcccggagtagtcacaggactgggcagtgaaaacaggttgacttggatcagctgatggttcttttgtcccatggatgttctgctggtactgcagtcatctggtagcccacttaaactagaatgtccatgacagctcattcacatggctagtgccttggatgtttgccacacgagtcactcgagagaatctctgagtcctggcgagggctttctgaggcttcgtgtgttagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaag

SEQ ID NO: 1460 - DNA, 3223 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggcctccctattccctgagacacaacagtattgaaattgggccaattaataaccccacagtggcctctcactaaatgtgagaggtgaggaagctgcaggagaaaatttgaagctagcagtgttcatgagatgtaagtaaagaagccatctccataaaagtacaacgtgacgcagcaagtgctgatggagaagctgtagaagttacacagaagatctagcttggaccatcgatgaaagtggctacactaaacaacagattttaaatgtagataaaacagcattttattggaaaaagatgccatctaggactttcatagttagaaaaactcaatgcctggcttcaaaggacaagctgactcttgtcaggggctagtgcagctgtgactttcagttaaagccaatgctcattgactattctgaaaatcccagggcccttaagatatgctgtataaacgcaacaacaaagcctggatgacgttgggtctgtttacagcctggtctactgagtaagcccactgttgagacctagtgctcagaaaaaatagatttctttcaaaatatggctgggtgcagtggctcacaccggtaatcccagcactttgggaggctggggcgggtggattgcttgatgccaggagttcaagaccagcctgggcaacatggtgaaaccctgtctcaaaaaacaaatccaaaaaaccaaaatattgctactcattaacaatgcacctggttacccaagagctctgatggagatgtacaaggagatgaatactgttttcatgcctgctaacacagtatccattctgctgctgatagatcaagaagtacttttgactttcaaaacttgttatttaagaaatacattttgtggtttctctgatggttctgggcagtcagttcaaaaccttctggaaaggattcaccattctagatgccatcaagagcattcaattcacgggaggaggtcaaaatatcaacattaattggaatttggaagaaatagattccaatcctcatggaggacttggagggtttcaagacttcagaggaggaaggaactgtagatgggctgaaaatagcaagagaactagaagtggaggggcctagagatgtgaccgaattgctgtaacctcaggatcaaacttgtatggatgagaagttccttctcatggacgagcaaagaaggtgatttcttgaaatggaatctactcctggtgaagatgctatgaacattgttgaaatgacaaaagatttagaatattccataaacttagctgtggccagggtttgagaggattgactcctaattttgaagttctactgtgggtaaatgctgtcaaacagcattgcatgccacagaggaatctctcatgaaagagttaataaatgcagcaaacttcactgttgtcttactttaagaaactgccacagtcactgcaggcttcagcaacttatcttttcctaccctcctctcgcatttaaaagtacttttaaattaatgtatgtacattatttttaggcataacactgctgctcatttaaaaaaactacagtatgaaccatgttatatgcagtggaaaggcaaaaaattcatgtgacttacttgcttgtatttggtttattgcagtggtctggaactgaaagtgatgcgtatttctgagttatgcctgtatttaagaagctgagtgaaacccaaagaagtccatgataggacagacttctgaaaactaaagacagaaaaaagcttgaaagcatcaagaaagaagtgaaatcttagctagagggaaaagtaactcagatgacagtggatttctctctggaaaccatggaggccagaaggaagtgagacaagttcttttagtgccagaagaactatcaacttgtggctgggcacggtggctcacacctgtaatcccagcactttgggagaccaaggtgggcagatcacttgaagtcaggagtttgagaccagcctggccaacatggcaaaaccctgtctctactaaaaatacaaaaattagccaggcatggtggcacatgcctgtaatctcagctacttgggaggctgaggcacgagaattacttgaacccgggaggtggaggttgcagtgagccaagatcctgccactgcactccagcctgggcaacagagcaagactgcctcaaaacaaaactctgtcaactccaaattcctatttggtgaaatgatccttcaggattgatggggtaataaaaacattctcggttgatagaaaact

SEQ ID NO: 1461 - DNA, 1509 bp, Homo sapiens
aggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccattgcacctggacttgatatgaaagtaaccatcagaaaatcaacagagatcttaaacttgcctaccacagacacctgcaggaatatactaagaatcatcatagtggacctttattgtctcctgagcacccattctttgttctttcagaaacacaactggttttgagaatccatcccttcttcactcagtccacgtaaaggttaggatggtagaaagtgttatacctcttcctccagagttggagcctatgacactgatgacactggcatggaaagccaaagccctacaccaaccagcacacttactggttccaaattgatctacgctggtgtaatcagagtgaatctcagaactttggacagagctgtgagcagagactgactttcctgctgtctccaggtagctgcaaggctgaacagcagcacctactttattaccatcttactgtcattcaaagaaggcagagctgaatgctggagaaaaactgagtactagcaacagtttttgaaccctgaatactgtcataactgaagctagaattatccctggacttgtttgccactaaaatttccttgttttgcttaccctggtttcagctggcaccctgatcacttgaaaggaacataactgatatactgtcctttgtttttctttccttcctcttctccgcctttgatgattttaaattagaaatctacctgcctctaatctctttaattttctcatttatttactgctgcctattttccaaaacactgcttctcgaatattcctggctcaaaaatcatctatgtcttcatgacatatgaaacccctagaatcca

SEQ ID NO: 1462 - DNA, 1177 bp, Homo sapiens
aagcctggaagaactcgtcatgctctttgtagcgtggtgcttctgttgctcacaggatgtttgccacacgagtcactcgagagaatctctgagtcctggcgagggctttctgaggcttcgtgtgttagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatgttgcacctggacttgatatgaaagtaaccatcagaaaatcaacagagatcttaaacttgcctaccacagacacctgcaggaatatactaagaatcatcatagtggacctttattgtctcctgagcacccattctttgttctttcagaaacacaactggttttgagaatccatcccttcttcactcagtccacgtaaaggttaggatggtagaaagtgttatacctcttcctccagagttggagcctatgacactgatgacactggcatggaaagccaaagccctacaccaaccagcacacttactggttccaaattgatctacgctggtgtaatcagagtgaatctcagaactttggacagagctgtgagcagagactgactttcctgctgtctccaggtagctgcaag

SEQ ID NO: 1463 - DNA, 1159 bp, Homo sapiens
agtcatctttatccctttaagcatggtttattttctgagcaaggagtcatcatgggagaccttttttccttattttgggaggtagatcctcccccaatacctgtaaattgtgccattccaaatcaggattatgaatgctggaaggatgactcttgtggaaccatagggagcttcctgctttggtattttgttatcgtatttgtcctgatgttcttctctagggcttctgtctggatgtctgaggataaaaaggatgaaggcagtgggacaagtacttcagtaaggaaagcaagcaaagagacttcctgtaagcggcaaagcaaagacagtgcctgggatccctcacaaacaatgaagaaaccaaagcagaaccaacttacccctgtaaccaactcagaagtggctttggtcaatgcctatcctgaacaaagacgagccaggcgccagtctcagttcaatgaggtgaaccagaaccaacatgacagtgatactacggagtatggcagtgaagagtctaactcagaagcctcctcgtggaaggagagtgaaagtgaacaccacccatcaccagacagtattaagaggagaaaaatggctcagaggcaaaggaatctgggaagttaccaaatgagcgaaaggcactgcctccactgcaaagccttgagaaccaacgaatggttggcgcaccattcccgacagaagccttcagtaacaccgccaatgaaaagagacagtcaagaggaaagttccatatctgacattaacaagaaatttagtaaattttgaattttatcacgttcttccttcacttgaagccaaatgaaagagatgaataaaacatgaaaaatcaccagagctataggtgaggagacttttacaacaaagtctctctaccaacaaacaaaaacatacttggaacccaagaggtaaaatctcacacaattcttcgttcaaaaaaaaaaaggccatcacgtgtttatggcaccattggaacaccaaagatctatatctgctatgatttttttatttgaaatagcacaagacagatattttgtgccttgagtgtatatattttgtgccttgagtgtatgtattttgtttatgtctgtaatatgaataagaaagctctttgaaaatgtattatttatgttgagaaacc

SEQ ID NO: 1464 - DNA, 1695 bp, Homo sapiens
agtccaataaaaacctcatcagttaccaactaaatcagggcatggtgtttttttgttgttttctttttaaagcatagttttagtaatatatttactaaaaaccttagacattatgaaaaaagtcaggatttggaatcttacactgcttggctaaattgacacaatatagaccaacagtttcatcctggggcttatgggtctcataggagcacccgtatgctgaagaaaggcaaagagagaactacagaatttgtagaaaagttttgttgtagttgcttctgaacaattagtttttgtttgtttgttttgttttgttttgtttttctggtaacctagcagtcaaagctcacatttttggacaatgactcattcttcccaggacactggttcttgtggcattcaggaagatggaaagctttatgtggtggattccataaatgacttaaacaaactaaacctctgtccagccggatcgcagcatctgttccctctagaggacaaaatcccagtccttggcacaaactcaggaaatggaagccggagtctgttttttgtggggctgctaattgtgctgattgtcagcctggcactggtttttttcgtgatatttctaatagttcaaactggaaacaagatggatgatgtgtcaagaagactaacagctgaaggaaaagacatagatgatcttaagagaatcaataacatgatcgtaaagcgactcaaccaactcaaccaactggactctgaacaaaactaaaggaatgattttctgaaagcacctgctaacaccttgagctttttactttcctgggagtgtacagggttaggaactgagaaagtgcacttcctcaggcaacagatgatctggtcaggcaacccacccctggggcccactttctgcagcaagatgggagcaattccaaggcaagtgggtatgggaatagcaactaaaaaggggtgaacttgtctcagcccccttttatggtagggcacttcaactttaatggggtgggcggctagcagggaggagaatcaacaaagcaagagaacttgactatgtacgtccaacttcttacagaaggagctttgctaccagaacaagttcactgtgtcaatgaagttcatgacacctcatgcacctttacagatatctgggaaagcctgagaaattcattgagttttatgtattgaagggaaccaggtgattactcttttcaataagagggattctgctcaggtgattagactttgactctatttccccagggacagtgatgggtgggccccagagctagttgctgtctggtgtttgctggtgaaaacatgagcagtagttatgtggggctgagagtcaaaagggaaagcctaattaattcaactaatgtttattaagctcctactctgtgcaaatcactctactcaagaggagctcacataagagtgcaggataaagaaaggagatggacagttatatgtaattatataaactttgtgtattttgtttctcatgaaaaaacccctttggcaccctgctgattgatttggaagaaatctgatagatttgtggcctttcctaaattgcactaggaaattatgtagttagaatatttggaacctgcattagttccagcaatgaaagtaagacacacagcatatgacataagacacagtgtgaaataaatgagtttaaaaagc

SEQ ID NO: 1465 - DNA, 541 bp, Homo sapiens
agtccaataaaaacctcatcagttaccaactaaatcagggcatggtgtttttttgttgttttctttttaaagcatagttttagtaatatatttactaaaaaccttagacattatgaaaaaagtcaggatttggaatcttacactgcttggctaaattgacacaatatagaccaacagtttcatcctggggcttatgggtctcataggagcacccgtatgctgaagaaaggcaaagagagaactacagaatttgtagaaaagttttgttgtagttgcttctgaacaattagtttttgtttgtttgttttgttttgttttgtttttctggtaacctagcagtcaaagctcacatttttggacaatgactcattcttcccaggacactggttcttgtggcattcaggaagatggaaagctttatgtggtggattccataaatgacttaaacaaactaaacctctgtccagccggatcgcagcatctgttcctgttaagacagtcttcaaagaactttccaaagaggtctaaggagatagcttaa

SEQ ID NO: 1466 - DNA, 730 bp, Homo sapiens
agtgtttgcaagtcagtcatcatagtggcagcttccgcctgctacaggatatttatatatggaagcataccatggcaggagtgctggaaaggtggtgtcagctaacagttgcttcagccagataaggacgggacaatgactcattcttcccaggacactggttcttgtggcattcaggaagatggaaagctttatgtggtggattccataaatgacttaaacaaactaaacctctgtccagccggatcgcagcatctgttccctctagaggacaaaatcccagtccttggcacaaactcaggaaatggaagccggagtctgttttttgtggggctgctaattgtgctgattgtcagcctggcactggtttttttcgtgatatttctaatagttcaaactggaaacaagatggatgatgtgtcaagaagactaacagctgaaggaaaagacatagatgatcttaagagaatcaataacatgatcgtaaagcgactcaaccaactcaaccaactggactctgaacaaaactaaaggaatgattttctgaaagcacctgctaacaccttgagctttttactttcctgggagtgtacagggttaggaactgagaaagtgcacttcctcaggcaacagatgatctggtcaggcaacccacccctggggcccactttctgcagcaagatgggagcaattccaaggcaagtgggtatgggaatagcaactaaaaagg

SEQ ID NO: 1467 - DNA, 1210 bp, Homo sapiens
caaacccttgttctgggttagaggtcctggtaccttcagttaacagtcgggtttcgtttgattttgttacggcgcccctgggccttcgattaataaggttcggtcaacggacaagtgagcggttccactgctcgtcagtcgatagggggagtcggtagtctgtccgaccgtaccattaggcgcctgggccggaggaggggttttcagggtcgtaggacgccgttgggcaccacgctcggagaaggacaggacaatggcggccttagggtccccgtcgcacacttttcgaggacttctgcgggagttgcgctacctgagcgcggccaccggccgaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtagcatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaattttttttaagtttaaggtttttctctgtaattttgtttactagttcttaggggaattaactggacatttcatctttactctcagtgaatttactgaactttttgcactagactgatgttgtttttctacttaaaaaaatttttttatattttattttaaaagtagtacaagccttagccaggcacggtggctcacgcctgtaatcccagcactttgggaggccaaggcaggcggatcacctgaggttgggagttcgcgaccagcctgaccaacatggaaaaaccccgtctctactaaaaatacaaaattagccaggcgtggtggcacatgcctgtaatcccagctactcaggaggctgggacaggagaatcgcttgaacccgggaggtggaggttgcgatgagctgagatcgcgccatggcactcactccagcctgggcaacaagagcaaaactctgtctcaaaaaaaaaaaaaaaattagtataagccttttgtttaaggaattcaaatgttataaacataaaataaaagaaaccctc

SEQ ID NO: 1468 - DNA, 5340 bp, Homo sapiens
ctgcccggccccgggtggctgcgatgccgaggtcctctgctcccgccgggcgtgcagcgggcgcgcgcgcgtgtgtttatgtgtctgtgtgcgtgtgtgtgtgtgtctctctctgtgtgtgtgtgagatgaattggagtcatacgactgggtgtttccttccgagtggttttcatcagcaatccattaggaaatcatggaaactttttttttcctggctaaaaggatgaaaactgagtcatccacttttgactgtcatccatggaagagctcttattaaaagcctcagactttcgggacctatgattctttggcacaaccttttggaaaattcttaagcagggatgaagcaaacttgattggagttggggaaaaagaagacagattagtatttttcatgctgacaaaaaatagctgctatgacttttcccgcaacgtggacaggggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagattctgttcattggagattcaaccaacagagggatcatgtactatcttattgaaaggctgaatgaaacgttgcaggaatggcagaaagtacatggcactaaattctatcacaacgtcaatggtgggaagactttgatcagttattcctactatccccagttctggataagcccttcattgagaccaacatttgaaaatgcacttgaacacctcttgcaaagatcacgtcccctagagaatactggccagactgtattggttgttggtggtgttcagtggcttaattccaatcacctgcaaattattcacaaagttttgaagagggaaaatttactcaatatcctagtgatcatcaaaactttgggaattggatttcatctgccagtggatggagtacatttcttaacacagagtgaagtacagaacttatggaaagaaaatttgattattctggatactgcaaaaaaacatggctatgaagtagttgacacattcactataacaatggggcgttacaaagagtttctacaggggaagtgtggatgtcatttccatgaggtagtgaaatcaaagttatccaaagaatataactttattaaaatgaaaagatcaagaaatcatatcatgggaagatatttcagcaatcaaagcaaactacaacaaggcactgtaacaaattttcgatcgccatatcatgtcagaggtccaataaatcaggtttgttctgaaatccttctcagcaggatgtgtgcaaataaaaggactatgtaggctccctgcaggagagctgaatctggagctggagacgagctagtcacccggacaatggtctaggagccaagcgctgcacatcgcacacatttgggatcgaccacacacacttgtgcacaccagcacatgcatgcacaccagtacacacacagttaaataatgataacacttcttacagctttatgaattcaagatgtgaccttgaacaccagtccatttcacagtgaaagatatacctagagaaacgttacttgaagcataattattaaccagaaccactgtgggccaggtatggcattgtgataataaagagaaatatagacacttaaaattatgtgaaaaaaaggataatgctctttcatgttgtcttaccatatctataggtacatcaatattgaaaaggagaaaaaccaatgacattccactggcaagtagaagttgtcctttcattctttaccaggagaaaatgtgatgtttatgatggcttaggctttgtgaatctaatgcttatgaaaaacatttcttcctatactttttaaattttattactgaaaggaaaagaacaggaatgttccacaagggaatttgaagagattctgtgagagagatatgaaatattttatagttaaaacaccaatatattcaactttacacttcttgtgtttttcataaacattccctcttgtcttatctgtgtacttcgatgggtaactgcagtctgaattaatgaaatatgtaattttaaagtaagtaacaaaatgtagttcctcatgtattactgtactatgtttcattgatgatattacttaaatcttgtgtttgccattacagccctatgtaacttaaaattacaattatattttatgtaaatattttgcaaaggactatgcattctgaaatgcataggtgctttttcccaccaagcatttgcatatgtccacaaatagtattatgttactagtatctatattttgattttcctgagcaactgtatcaaatccaaatttagattagacaaaaaattattattttaattaaactgtggcatacatataatacatacctaattatagtagtgagaactatttcttttatctctttaggttcaaaatggtgaatttctttattatatgaatgctttgttgtgagataacatcacactgttacaatggattttagaggtttgtcttttttgggtggggtgggaagctgagagggttaattcaatacatggctgaaattaccaaatgtataaatacctcattttcactaccatacaagaaaaaaacacctattttgattgatcagttcttttgtatgaatatccacctcctttaaatactctatttttatatatatttttatatgaagataaacatgaatttatatttaactgtcttaaattatatttacataaatgcaaatatcacttgatataaacaatacaaatctgcatcttacagatgataatttttttagaagaatgatacagaattaactttaaaaataaaacttttctaatatacacttaaatgcaaacatcatttttaaattttcagtgatttttttaatgacataaaacgttaccaatgtgtgcagcctctccatcatgttttaacatactgtatactctatagcagtattacagtcagtatttcatataattttctttagacctaactgttaccatctgactgaggttactctggtatttatctcttcgctgctgaaataataatggattttagaaacaattgtaataatatcattaataaatgtcttactagtaata

SEQ ID NO: 1469 - DNA, 609 bp, Homo sapiens
atggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaagcagctcaggcggcgggaggagcggcagcggccaggcagcccagcttcgcgaaggctctcggtacgatga

SEQ ID NO: 1470 - DNA, 2219 bp, Homo sapiens
aaaactaaatgaagggaagcatacaaaaggctgaaagcaagactgctttaaaaccggaggaaaattgaggaactgctaaggcaacctggcctgagttcagctgtgcaacaggcactttgggttttaatcttttgcgttcttcaatgctgttttcagactccagatatactttggtattgttttctctcttcctgcaaagctgaggcagagtcggactcctttactgtgagttgaaagatgtgagaataaggcattgctggaagcaacagtttggcagcctggggtacactcaggttattcgttacaactattattatttgatgtctttttttaaactcaggtcatccacttttgactgtcatccatggaagagctcttattaaaagcctcagactttcgggacctatgattctttggcacaaccttttggaaaattcttaagcagggatgaagcaaacttgattggagttggggaaaaagaagacagattagtatttttcatgctgacaaaaaatagctgctatgacttttcccgcaacgtggacaggggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaag

SEQ ID NO: 1471 - DNA, 2501 bp, Homo sapiens
ggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagttgggtgtcgatgtccagagagttcctagaagccgtaattgaagacacaatccagtcatcctgggaccctaaatgacctccctgccccacccctgcacataaacctgacttgaatcacctggactatttttctgagagagtaataaactttaattgggtttgacctat

SEQ ID NO: 1472 - DNA, 435 bp, Homo sapiens
cagaaaacatatgttgatcccaaacatgcaatgacatccatataaaccttgcaaaatgatggctgtgatgacacccagtgatggtctttctcaactctctgtacctcatctcactcatcagagactttggagcctcagttgccttgcaatgctgtttcaggctgtactcattctttctgcaccacaaatgtcatgccttctcaagtgtttttatgccctggacccattgcatccagtgatgtcagaggaattctcagctcaatatcgtcacatgatggatcagagatacagaactagaattcatgagggatacatatctcaagtgaaaggtgcatatctacggattgtccacaagaaaccaatcagttatgcaaaatcttttccaaaggaaatgggaaattaaggaaaaaagtgaataaaactttacaaaaatga

SEQ ID NO: 1473 - DNA, 2775 bp, Homo sapiens
ctcagttttctaatctgaaaaatgagaatattaaccatagacaactgccactcactgaacaccagctgcagtagagccgagcatacacgtaatcctcaccgcaaccataggagctggatcctgacatccccatctcacagaggaggagactgaggttaatgacgtggcaaatatccacaatgacagtttctgcaagtctttcctagtgcaatcacccacaaccacagccctagaaagaaggatgaacactcttccacagaggctggcacgcaccttaaggcaggtgcccactggaaccctgtctgtggtgtcaaggattttacagttgaccttgaagaccacctagtccaaagctctcattgtacaaaaagccaagcccagaggtcacacaaagctttggacctgagcctctgggccccgcggtctggaaagtgctcctttctctgcatgctacggggctatcaacttgagctggtccagtctgcagatctacatcctgcccgcctgagcagaggcgggtgtgggaccagtgcggatctccacgatttgtcagcccatcctgataagtctgaggctctgaccatcatatctcatcacagcatcattaggattacaagtgccatgcggtagaagaggaagggaaacacgaacaaaaggatgagaaattaagcccatttcacccggaaaagatgactctgatttattgctctatagcagctgacgatggcctgtcagagaaattctgtgttgaaaataaagaataaaaatcacccagagttgttttgccacacatccaaattagaaaatgctactctccggatgatttatgcttcaattttttcccttattcacagagaatttgtccagcattacaagagcacctaagagcaataatacaattcaaaaggagatagaagaggccgcagaggtgttgatgtgcggctgagggcggggtgctggcccaaaggcagggctttggtgctcagaagcattgaccttacagggaggaacaaggagaaaccagccaggcaggccccgcaggcagcccacagagccacttcgccgtgcagccgagggagtcccgcaccacggggcctcgctcagggtagccaccatgggagaatgtccccacctcgtggatgtcaggcttggccacaggtccttggccacgggacctgagcagagtgacatatgccacactggatcagaagcacgctggaccaccacgtggtatggctccctttctttctcccgtcataagtacaagatgttggctgacctgactcctggggtagaaatgtcatgtagacactgggcgcggtggctcacgcctgtaatcccagcactttggaaggccgaggcaggtggattgcctgagctcaggagttcgagaccagcctggacaacatggtgaaacccgtctctactaatttacaaaaaaaattagccaggtgtgttggcacatgcctgtagtcccagctacgtgggaggctgaggcacgagaattgcctgaaccccagaggtggaggttgcagtgagccgagatggtacctctgcactgcagcctgggcaacagaatgagactgtgtcttcaaaaaaaaaaagcactgtcatgcagggcagggtcccaaggccccagccaacctctcgttgacatgtaatgtaagaagatgtcaactcatgcttatagtcactgacatttaggaatagtctgttaccacagcataagctggtaaaaaaaaaaaaaaaaatcatacagctcttcttcccggaacgcccctgcacctctgctccggtgcacaaatgctttctcttcaaggcatggcgcaaaaaagccactacttccagaagcatctcctcattccccgccgggagcaacatctctcttctcgagaccccagcccctccgctgtctacccatggacttcctcagtgtttgttttttgcatgattctttgtgaccaagctgtttctccagctgccttgaggacatgccctagggaacagtgctctgaatcgtacctggattctgtgcctacctgctccatctaaagcagaaaactccacaactaagatctcttctaacatttaaggaatagagcctaattagcgcatgaatacgtgttgaactgtgaatgaatcaatgagtatggaaactacattatacgcagtgctgatagaaccaagttgccaagggagatatcatctctcctgcaggaaggaagtcctgcctcccactgatccactcagcgcacagccttgaacaaaacagagcaagagttataaccttcagatgtgggggcagaataggacccatttgggcagacacaggccacggaaaccacagggccagcgtcttgagccctcgatcagacgcctcccgcccaccgcggccgcttctccacgcttttgcccagatctctgcaccgcgtggcccggtcttgcctccctgaggaccacactggctgcaacccaaactcgactcttctacttacacttgctcagcatttttgtcatccctgcccttggccaatccctgtcttggtttctgctcttcccacacaaagttttgggaatcaattcatacatatttgagattaaccaaagtccatgatcagttctggaccgctatggattccagatccaccttacgtagccgtgtgagctccggtaaattacataacccatcaaatttctttatctataaagcagcaacaataatgtcacgaaggattaaggtaaagatgagaaatagtatagcaaaagcatctacta

SEQ ID NO: 1474 - DNA, 793 bp, Homo sapiens
gtaaccgtttcccgcgcgcccggccccgactccggggtaaagagccccggagcggagcagcgctggccgcgtgccgcctccggagccggcagcccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataataa

SEQ ID NO: 1475 - DNA, 691 bp, Homo sapiens
cgcgggggtaaggggggtggccgcccgcctgccctcggtcccgtgcggtccccgaaactccgagcacccgcccggtcccggcgcggagcccctcggcgtcgcgtggagctgcgagtcgcccgcttccggaagcgcacacgggccagttgcggcggcccatctgccggggcggcgggggctcggcgggagggttgaggctgaatcacgcgcagcctgcgggcggcggaaacgtccctagagcctcgccgccctgggacccgggctgcttcctgggagaggattacattttctccctgctccacttgactttcttccggaaggagcaggtctcgcaggatcggggccaagactggaagagttcagccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatga

SEQ ID NO: 1476 - DNA, 1466 bp, Homo sapiens
gctcggtaaccgtttcccgcgcgcccggccccgactccggggtaaagagccccggagcggagcagcgctggccgcgtgccgcctccggagccggcagcgtgagtggccccgcgtccccgcttctcccggtccccggcggggccgcgtcacccggccccgccccgcgccgcccgccccgccccggacgcgggggtaaggggggtggccgcccgcctgccctcggtcccgtgcggtccccgaaactccgagcacccgcccggtcccggcgcggagcccctcggcgtcgcgtggagctgcgagtcgcccgcttccggaagcgcacacgggccagttgcggcggcccatctgccggggcggcgggggctcggcgggagggttgaggctgaatcacgcgcagcctgcgggcggcggaaacgtccctagagcctcgccgccctgggacccgggctgcttcctgggagaggattacattttctccctgctccacttgactttcttccggaaggagcaggtctcgcaggatcggggccaagactggaagagttcaggtttgggagtcgtgtgtataacagccccgcgcctccacgcccaggcctgtgtggctttggacaagttatataaccaccgccgccaccccagtttcttctcctgtaaaatggagctttagtgccgcccagcagggttgttgggataattcagtgactctgtggactgcccagcacctgtgaattgctttcctggatgttgggtgaaggcctgtgagcttccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataataa

SEQ ID NO: 1477 - DNA, 773 bp, Homo sapiens
accccaagcgcgcacagcggagcaggaggcgcccggcactcgcagccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataataacttcctgtttcattgtattctgtgagtg

SEQ ID NO: 1478 - DNA, 487 bp, Homo sapiens
cattaattaaaagaaaccctgctttcttttctctcttacagccccatggctgggggttatggagtgatgggtgacgatggttctattgattatactgttcacgaagcctggaatgaagccaccaatgtttacttgatagttatccttgttagcttcggtctcttcatgtatgccaaaaggaacaaaaggagaattatgaggatattcagtgtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttc

SEQ ID NO: 1479 - DNA, 2476 bp, Homo sapiens
gcggggcggaccggaaggggcgtcaccggcacacgcctctcggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccgctccccacggcgcgcgccccccgcgcacccgactccggcgccctccggattggcctgcgctcgagacgtcaggcactggcggcgggcgcggggctctggtgcgcgtgcgcgagcgtcccccgccccctcccagcccggcgactgctcgggcccggccgccacctgcacggcgggggagccgctcgccgcgggagcgtcaggtgaggggacgcccgacccaaggtcaccaggcgtgggggcgctgggggatcggggaccatcccggctctgaccctggtgcgctccgagaagggcgtgggtcctggagggggatggggaacgcggaggccacgccctccctgagcccggccgaaaatcaaccggctctcgtgggtagcagaggaggccgtgggggatacaggcaccaggtcgcagcgctgcagaggtgcgcaagggccgcccaaagaccagcttgggcctcgcactgcgcccgaggcagacacagggcgttccatcctcttccctccccgctcccgcacagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttacttatttctagtgactttaaataatcatgtgagttacaatttagggcaagatttaaacaccaaggccacttggtcctgtccctttccacatgactcgaaaggaggaagagctgatggacaggcaaatgtttggggaggccggccagatgaggctgggagacaggacacctgcagccctgttttccctggcttcgggtgggctggctggcttagcccagatccctacttttaaaactgggctccttgttcctgaaaccagaccccagccttcccatttctttacgacaagtacatgtatatggtcccccagcaaactccctgctccttgctgatctcagaggtcacactgctcccagagcccacttgggaagccacaccagaaacccagttggtggcccaaggcgtcccctgtcccaccccagctttcccagggccccatctatccccaaagacaggacacctttctggggaccggcatgggaagca

SEQ ID NO: 1480 - DNA, 1596 bp, Homo sapiens
gtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttataggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaatta

SEQ ID NO: 1481 - DNA, 805 bp, Homo sapiens
cgaggggattggggagaccctgcccgggaagctcggggtccgggaatgaaagcgggcgcacctctttagcgagccctaaagcgtttgggagacgatcgttccgtccctgggagcggcacttggtggggctgggcggagggaggctctgcaagagaaacccggagtccgggaaacccagtagtttctggaggctgctcacattccttggcttatggcctccttcttccaacgtcaaagccagcaacattgcagcaatctgacttattttgttgtcatgtctcctgaccacatctggaagggttatctacttttgaagacacatccagataattcaggacaatctgtccattttgaggttcttcattgaatcatgtctgcaaagtcccttctgcaatctaagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacg

SEQ ID NO: 1482 - DNA, 3563 bp, Homo sapiens
ctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaa

SEQ ID NO: 1483 - DNA, 555 bp, Homo sapiens
gtgctgaccgattactcgcggtcgcttacttgtcagtgcagctctctgggttctgccgttcccttttggggccccctttcccatgtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaa

SEQ ID NO: 1484 - DNA, 1829 bp, Homo sapiens
gtgcggctggcttgtcccgcccctgcccctgagtgacagaaccgtggacagcaacatttcccacaggacacgaagtttgtcggcccttgccttggcagagctgagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttataggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgct

SEQ ID NO: 1485 - DNA, 1808 bp, Homo sapiens
actccggcaattctggcctctccagcctcttgcctttcttctgaggggagccttttatcctgctgtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaa

SEQ ID NO: 1486 - DNA, 774 bp, Homo sapiens
ggtgtgcggctggcttgtcccgcccctgcccctgagtgacagaaccgtggacagcaacatttcccacaggacacgaagtttgtcggcccttgccttggcagagctgaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacaga

SEQ ID NO: 1487 - DNA, 3672 bp, Homo sapiens
cctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaa

SEQ ID NO: 1488 - DNA, 556 bp, Homo sapiens
tcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtttctggaggctgctcacattccttggcttatggcctccttcttccaacgtcaaagccagcaacattgcagcaatctgacttattttgttgtcatgtctcctgaccacatctggaagggttatctacttttgaagacacatccagataattcaggacaatctgtccattttgaggttcttcattgaatcatgtctgcaaagtcccttctgcaatctaagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaaggcattttggagatcaaagatgggtagaaaagatgctgctac

SEQ ID NO: 1489 - DNA, 737 bp, Homo sapiens
tttgtcggcccttgccttggcagagctgaggtgtgtgtccggcgagtgcgaggggattggggagaccctgcccgggaagctcggggtccgggaatgaaagcgggcgcacctctttagcgagccctaaagcgtttgggagacgatcgttccgtccctgggagcggcacttggtggggctgggcggagggaggctctgcaagagaaacccggagtccgggaaacccagtagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttc

SEQ ID NO: 1490 - DNA, 3510 bp, Homo sapiens
ctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatc

SEQ ID NO: 1491 - DNA, 723 bp, Homo sapiens
agacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacgataaaactgtcaatgcaactacatatgaaaaatccaccattgaagaagaaacaactactagcgaaccctctcataaaaatattcaaagtatttaaattactacactgtattcatacctggagaatatcattatgtgacttaaaaatttaagtttcactactctgagcattacataaagccatagcatgcttaaagaatttatactgctaccttttaaagtcactaaaatcttttaaatggtgaatgtctaacagtcagtcttcaggtatacctgacaaaggatgagaaatgagcttttgtagaaatagaactttattttaataaaaatgtgttacatttgtgtctatattaaa

SEQ ID NO: 1492 - DNA, 1031 bp, Homo sapiens
gttagacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacgataaaactgtcaatgcaactacatatgaaaaatccaccattgaagaagaaacaactactagcgaaccctctcataaaaatattcaaagatcaaccccaaacgtgcctgcattttggacaatgttagctaaagctataaatggaacagcagtggtcatggatgataaagatcaattatttcacccaattccagagtctgatgtgaatgctacacagggagaaaatcagccagatctagaggatctgaagatcaaaataatgctgggaatctcgttgatgaccctcctcctctttgtggtcctcttggcattctgtagtgctacactgtacaaactgaggcatctgagttataaaagttgtgagagtcagtactctgtcaacccagagctggccacgatgtcttactttcatccatcagaaggtgtttcagatacatccttttccaagagtgcagagagcagcacatttttgggtaccacttcttcagatatgagaagatcaggcacaagaacatcagaatctaagataatgacggatatcatttccataggctcagataatgagatgcatgaaaacgatgagtcggttacccggtgaagaaatcaaggaacccggtgaagaaatcttattgatgaataaataactttaattattttgtc

SEQ ID NO: 1493 - DNA, 947 bp, Homo sapiens
gttagacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacggatcaaccccaaacgtgcctgcattttggacaatgttagctaaagctataaatggaacagcagtggtcatggatgataaagatcaattatttcacccaattccagagtctgatgtgaatgctacacagggagaaaatcagccagatctagaggatctgaagatcaaaataatgctgggaatctcgttgatgaccctcctcctctttgtggtcctcttggcattctgtagtgctacactgtacaaactgaggcatctgagttataaaagttgtgagagtcagtactctgtcaacccagagctggccacgatgtcttactttcatccatcagaaggtgtttcagatacatccttttccaagagtgcagagagcagcacatttttgggtaccacttcttcagatatgagaagatcaggcacaagaacatcagaatctaagataatgacggatatcatttccataggctcagataatgagatgcatgaaaacgatgagtcggttacccggtgaagaaatcaaggaacccggtgaagaaatcttattgatgaataaataactttaattattttgtcatc

SEQ ID NO: 1494 - DNA, 2755 bp, Homo sapiens
taaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagcattgccacctggggtatcgttgtcatggcagaccccaaagggaaggcctaccgcgttgtttgaaagtaccaccagtgaatctgtcttctgtctctgtccctttccccgtgacacacacagcaggcatggaatttaatgggtgttctggacagacacttgtacatggacagacatcactactgtggatactacaagactgagaagaaaatcgtatgttgtcattctctggctatggagtgtttgtggccttcacagatttcacaggaaccaataaatccctcagagaagtaaacaggttctttgtcttatctggggaaggaaagtataacttatatttaaatataattgcttaattaagcattatatataaacataatagtatgtcttatataattgcatgtcatattatatataataaacataaatatgtttagttatatagttagtataatttttaaaacttttaaatacagcatatggtaaaccaacgggaaaattagctattttacttcattattttaaagagttctttttatttctttcataattggatcaacaactgttaacctaaccctgggtgggcatcatgcaatatatagaagtacgtgaaattttctgtgtatgaattgctgatactttgcaaggcattttcaaatccatcaccttatgagagcttcacagctagtctgaggtagttacttcattggaggtaaaacttaaaacacaagaaagagcccacatgatttgcctagggtcattcagtaagtccgtgatggagctagaacttgttcttgtcagttttttgttctagtcttccctttcatggaggcaagaataaccattatgaaacagttagataatcataaaaatcagcatacaataaaagacttaaatgtcacaagaaaaattcaaaacctttagctaaaaaaaaaaaagatcttttgattctttttccacaagcactagatatgtttctgtgatgattttgagataagtactcaaaattacatagttcatttctaagagaaggccatgttttctacctattgggtttttctaccctgagatactatggcttctttgtaaaggtatataaagtgtttttcaaagcggaaagatactgttaaattcagctgctaatcatagtgtatttgtttggaatgacatgttgagcaggtagtacctttacggctgttgctttttgcagcattatgtggaagtgcctaagtctatttagcctcacagatgactttagaatcttgtattttctacatcagagttcatagcggggatggtgctacatatatctatgcaactgaaaaagaaaacatttcaaacctaaagtacgcaacaagatattatttatatgaaatccatagctcagttatgctatgttcatgaatagagaagttttaagttggaagggaccatggatgacccaaagcagatacatatggtcattcatatacctaaaatacctacaaagacaagttgttccctggtttaaaaggcagtctgttctattgatggactgctttagtccctgaacattttctttggttaaaccaaaaacacataaacctaacttggtcttggcttgatctactgggtaaataataactcttaaatatatatacagttgacccttggacaacacaggagttaagagcgctgaacatttgctcagtggagaatctgcatataacctgactcctcaaaaacttaattagtagttagtttacaattgactggaagccttattgataacataaagcagttgattaacacattttttgtgttgtatgtattatattccgtattcttacaagaaggtaagctagagaaaaaaaaaatgttattaaggaagtaatatattcactattcgttaggtagaagtgaatcatcctaaaggtcttcatcctcatcttcacgctgagtagtctgaggagcaagaggagttggtctttctgtcccagtggcagaggtggaagaaaatccacagatacgtggacctgcgcagttcaaacctgtgttgtttgggtcaactgtattgtaatagcattttaatgtttttctcagacttttacgagtatgaatctgagctttttctgaataaacctgcctgctcaccattaataatgccaaa

SEQ ID NO: 1495 - DNA, 4223 bp, Homo sapiens
agctgcgaggcgggaggaggtgaggctccggcgcacacccaaaccgcgctgcgcccgctccttccgggccccggagatggcgcctccaccgggatgagctagccagcctgggcaataccagaggcggccctcggcgcgcgcaggggaccgagctggtcgccccaaccggcaaagcagtcatctaatcttgaatgaaggatctgatcccagctcctgtgtcctaggtttgatttctgatgactctggcctgagttccaggatggttttttcttgggaccagacatgaacaaaagttgacctcatgagcacttcaacctctccagctgccatgctcctccggaggctgcggcgactctcctggggcagcactgctgtccagctcttcatcctaacagtggtgacgtttggcctgctggcccccctggcctgtcaccgacttctacactcttacttctatctgcgccattggcatctgaaccaaatgagccaagagttcctgcagcaaagcttgaaagagggtgaggctgccctccactattttgaggagcttccctctgccaatggctcagtgcccattgtctggcaggccaccccccggccctggctggtgatcaccatcatcactgtggacaggcagcctggcttccactacgtcctgcaggttgtgtcccagttccaccggcttcttcagcaatgtggcccccagtgcgaggggcaccaactcttcctgtgcaacgtggagcgtagtgtgagccattttgatgccaagttgctctccaagtatgtccctgtggccaatcgctatgagggcactgaggatgattatggtgatgacccttcgaccaactcgtttgagaaagagaagcaggactatgtctattgcctggagtcatccctgcagacctacaacccagactacgtcctgatggtagaagacgatgctgtaccagaagagcagatcttcccagtcttggagcaccttctgcgggctcgcttctctgagccacatctcagagatgccctttatctcaagctgtatcaccccgagaggctccagcactacatcaatccagagcccatgcggatcctggaatgggttggtgtaggcatgttgctggggcccttactaacctggatatacatgaggtttgccagccgcccagggtttagctggcctgtaatgctcttcttctccctgtatagcatgggtctggtggagctggtgggtcggcactatttcctggaactgcggcggctgagtccttccctgtacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcatttttcctgactttcctggctgactgcttaccttcatttctttttcttctaggtagcatgatgttatagaaaaaaaaaaaaaaaaatcatggactgaagtcagaagacctgaccttttatttcagatctctgccatggcctaacgacgtgaccaccttgggcaggtcatataatcactctgggtctcaatttcttcacctgtaaaatgaggacagtaatacttacatgttaaagttgccttgaggattaaatggcagaatatatgtaaaacacctagcaagtgcttagtccatagaagacgcttggcaaacttttctctcctataataaacatatacaactcaagcttatttcggaaaaagatattggtgatgttgtttaaagtatgagatagggcatggagctgccacctatgtaccagctattccagatgaccaagccctgctagaataaagactgacttttcattgtgacctctgaaggatgtgcagctcagctttcacctatccccacgttcacccaagccaaaaagaagaattgttcattcaaactggaaatgatctccagcttggaaatgagactcctcatgagcttattctaagatcagagtctgaaaattattttctcaaaagttacaaataaatgtcttttaacagtactgtcagactagtgaccaacaagttactttatgaggatggatgatgatattagagttcaagcaattgtccagtttgtttcgatgccacagtttgcttttaaattcccatagtgagcttccatcttgagacccactcaacacagaaggattacataaaggttgatcacccacgctctacagatgaacaaattgagacccagagatgctaaactgctctgcaggtcacaaacctgaacagcagcatagccaaaatgggaacggagctcttctgacttcaagcccctgcacttttttcttaaccacattaattttatgaatatctatgtggtcaaagtctcttttgtaaaatctgagtataagctgaactagatcatgtctctgtaagctaagatggcagaaacacattgtcatgttagtttggaggagcaaacagatataagtatgtgttgtaatgttatagtgagctgttatgtatcccccagcaatgtccaaagtgatcagagctactagatgacttattacaatgttcagatcccactccttcattcctcctctctcagtgacctgtctacccccaagctttagaactgagctctctccaacttagaactcattagagtttgttgcattagtgattggatctcctcatgaaagttttttgaccaatgacagtagagcccctttaagctagccaggcccaagatagggaagcactgctggtttacatttctgctctttctaattcagttgtctattgcatgcagacatcccctgcccgacttctccattatggaaggctaaggccatccttccttgtccagtttctctacctacacactaacatgccttttccccatggagtgaactctgccagttgtctttggacattttctgcagatgcaggctcagttctgctcttttgttcccacccacttctagatcttcctccatttaatcccttattcttataaggagtctaatttttgtgtattgtccttgattagggcagctgacagctttacaccaaagctgaagtctctcacttaatcctaagcaaggggctagggagaactaagatatccttcccatatcaagggatataggttactagaagggtggaggtctcttaacaggctcactcacctttcagagtttaaattatggtcaggcttaagaagctctctcttgtgactgagtgtattgcatagacatgtctgtgaaaataaaagcacccattttgctaagg

SEQ ID NO: 1496 - DNA, 4244 bp, Homo sapiens
gccgctttgggggccgcggtctctccgcagctcgcgggtcacatggcccgcctgagcaaggggagccctgcgcctgagctgcgaggcgggaggaggtgaggctccggcgcacacccaaaccgcgctgcgcccgctccttccgggccccggagatggcgcctccaccgggatgagctagccagcctgggcaataccagaggcggccctcggcgcgcgcaggggaccgagctggtcgccccaaccgggtttgatttctgatgactctggcctgagttccaggatggttttttcttgggaccagacatgaacaaaagttgacctcatgagcacttcaacctctccagctgccatgctcctccggaggctgcggcgactctcctggggcagcactgctgtccagctcttcatcctaacagtggtgacgtttggcctgctggcccccctggcctgtcaccgacttctacactcttacttctatctgcgccattggcatctgaaccaaatgagccaagagttcctgcagcaaagcttgaaagagggtgaggctgccctccactattttgaggagcttccctctgccaatggctcagtgcccattgtctggcaggccaccccccggccctggctggtgatcaccatcatcactgtggacaggcagcctggcttccactacgtcctgcaggttgtgtcccagttccaccggcttcttcagcaatgtggcccccagtgcgaggggcaccaactcttcctgtgcaacgtggagcgtagtgtgagccattttgatgccaagttgctctccaagtatgtccctgtggccaatcgctatgagggcactgaggatgattatggtgatgacccttcgaccaactcgtttgagaaagagaagcaggactatgtctattgcctggagtcatccctgcagacctacaacccagactacgtcctgatggtagaagacgatgctgtaccagaagagcagatcttcccagtcttggagcaccttctgcgggctcgcttctctgagccacatctcagagatgccctttatctcaagctgtatcaccccgagaggctccagcactacatcaatccagagcccatgcggatcctggaatgggttggtgtaggcatgttgctggggcccttactaacctggatatacatgaggtttgccagccgcccagggtttagctggcctgtaatgctcttcttctccctgtatagcatgggtctggtggagctggtgggtcggcactatttcctggaactgcggcggctgagtccttccctgtacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcatttttcctgactttcctggctgactgcttaccttcatttctttttcttctaggtagcatgatgttatagaaaaaaaaaaaaaaaaatcatggactgaagtcagaagacctgaccttttatttcagatctctgccatggcctaacgacgtgaccaccttgggcaggtcatataatcactctgggtctcaatttcttcacctgtaaaatgaggacagtaatacttacatgttaaagttgccttgaggattaaatggcagaatatatgtaaaacacctagcaagtgcttagtccatagaagacgcttggcaaacttttctctcctataataaacatatacaactcaagcttatttcggaaaaagatattggtgatgttgtttaaagtatgagatagggcatggagctgccacctatgtaccagctattccagatgaccaagccctgctagaataaagactgacttttcattgtgacctctgaaggatgtgcagctcagctttcacctatccccacgttcacccaagccaaaaagaagaattgttcattcaaactggaaatgatctccagcttggaaatgagactcctcatgagcttattctaagatcagagtctgaaaattattttctcaaaagttacaaataaatgtcttttaacagtactgtcagactagtgaccaacaagttactttatgaggatggatgatgatattagagttcaagcaattgtccagtttgtttcgatgccacagtttgcttttaaattcccatagtgagcttccatcttgagacccactcaacacagaaggattacataaaggttgatcacccacgctctacagatgaacaaattgagacccagagatgctaaactgctctgcaggtcacaaacctgaacagcagcatagccaaaatgggaacggagctcttctgacttcaagcccctgcacttttttcttaaccacattaattttatgaatatctatgtggtcaaagtctcttttgtaaaatctgagtataagctgaactagatcatgtctctgtaagctaagatggcagaaacacattgtcatgttagtttggaggagcaaacagatataagtatgtgttgtaatgttatagtgagctgttatgtatcccccagcaatgtccaaagtgatcagagctactagatgacttattacaatgttcagatcccactccttcattcctcctctctcagtgacctgtctacccccaagctttagaactgagctctctccaacttagaactcattagagtttgttgcattagtgattggatctcctcatgaaagttttttgaccaatgacagtagagcccctttaagctagccaggcccaagatagggaagcactgctggtttacatttctgctctttctaattcagttgtctattgcatgcagacatcccctgcccgacttctccattatggaaggctaaggccatccttccttgtccagtttctctacctacacactaacatgccttttccccatggagtgaactctgccagttgtctttggacattttctgcagatgcaggctcagttctgctcttttgttcccacccacttctagatcttcctccatttaatcccttattcttataaggagtctaatttttgtgtattgtccttgattagggcagctgacagctttacaccaaagctgaagtctctcacttaatcctaagcaaggggctagggagaactaagatatccttcccatatcaagggatataggttactagaagggtggaggtctcttaacaggctcactcacctttcagagtttaaattatggtcaggcttaagaagctctctcttgtgactgagtgtattgcatagacatgtctgtgaaaataaaagcacccattttgctaagg

SEQ ID NO: 1497 - DNA, 5070 bp, Homo sapiens
gttggtacccctacgtgctgaaatgaagagttctggagagaatctgagggatttgaggaatttcagatgttggggattttttcccccgcacagggagcggtattctgccctgtctacacattagaatcacttggcctggacaaaagcttttttaaaaaagcgttcccctcatctcctccccccaaaccccgcatttccatccactagattctaatgcgtaagcaggagtgacaactactgcccttgtgcttttttgggaacaagaaattgtccagggaaaagataaacgccaatcagtctctgatctcagtactagtctattttaagctaattaagcattgatttttttttttaagtttatgacaaactgctattttccattcagttaaactaaatgcgttttaatgataggacggtaattaatctaacctattaatgaaaagctgtatgtctcgcagaactatgataaactacctaatgacgtcagctaagggtctagaaatggaagaatgatcgctatatcttttttaaaaaatagaatttaggcatcttgggaaaaaaagaagctaatctacactggatttctgttagtgtgaagacttttgtccctgtacctgctagggcttacctgtaaatgaagtaagatggtcaacaccagggaaacaagtgttcctggtgcctggcagtggaacaccttgactatcttggaaagaattaactggccccaagtggacttcacatttcattccgtgaagtgggagcctgagaacatattttctgtgtgaggctgaaactgttggaggcttcctgagatcattcttgagaatggagcgaccacataggggtgagcagaaccaagagaatctcagggaaatggagccaatcaactgagttaggtcacccctaacttcaacccacacttgagtgttagagaagattctacaaagagagcagacttttctagtacctttcaattctcaccataaatatagcatgttgattaagagaatggactctgaagccggatttcatcagtttggattttggcttttcctctttctagcagtttgggtttgatttctgatgactctggcctgagttccaggatggttttttcttgggaccagacatgaacaaaagttgacctcatgagcacttcaacctctccagctgccatgctcctccggaggctgcggcgactctcctggggcagcactgctgtccagctcttcatcctaacagtggtgacgtttggcctgctggcccccctggcctgtcaccgacttctacactcttacttctatctgcgccattggcatctgaaccaaatgagccaagagttcctgcagcaaagcttgaaagagggtgaggctgccctccactattttgaggagcttccctctgccaatggctcagtgcccattgtctggcaggccaccccccggccctggctggtgatcaccatcatcactgtggacaggcagcctggcttccactacgtcctgcaggttgtgtcccagttccaccggcttcttcagcaatgtggcccccagtgcgaggggcaccaactcttcctgtgcaacgtggagcgtagtgtgagccattttgatgccaagttgctctccaagtatgtccctgtggccaatcgctatgagggcactgaggatgattatggtgatgacccttcgaccaactcgtttgagaaagagaagcaggactatgtctattgcctggagtcatccctgcagacctacaacccagactacgtcctgatggtagaagacgatgctgtaccagaagagcagatcttcccagtcttggagcaccttctgcgggctcgcttctctgagccacatctcagagatgccctttatctcaagctgtatcaccccgagaggctccagcactacatcaatccagagcccatgcggatcctggaatgggttggtgtaggcatgttgctggggcccttactaacctggatatacatgaggtttgccagccgcccagggtttagctggcctgtaatgctcttcttctccctgtatagcatgggtctggtggagctggtgggtcggcactatttcctggaactgcggcggctgagtccttccctgtacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcatttttcctgactttcctggctgactgcttaccttcatttctttttcttctaggtagcatgatgttatagaaaaaaaaaaaaaaaaatcatggactgaagtcagaagacctgaccttttatttcagatctctgccatggcctaacgacgtgaccaccttgggcaggtcatataatcactctgggtctcaatttcttcacctgtaaaatgaggacagtaatacttacatgttaaagttgccttgaggattaaatggcagaatatatgtaaaacacctagcaagtgcttagtccatagaagacgcttggcaaacttttctctcctataataaacatatacaactcaagcttatttcggaaaaagatattggtgatgttgtttaaagtatgagatagggcatggagctgccacctatgtaccagctattccagatgaccaagccctgctagaataaagactgacttttcattgtgacctctgaaggatgtgcagctcagctttcacctatccccacgttcacccaagccaaaaagaagaattgttcattcaaactggaaatgatctccagcttggaaatgagactcctcatgagcttattctaagatcagagtctgaaaattattttctcaaaagttacaaataaatgtcttttaacagtactgtcagactagtgaccaacaagttactttatgaggatggatgatgatattagagttcaagcaattgtccagtttgtttcgatgccacagtttgcttttaaattcccatagtgagcttccatcttgagacccactcaacacagaaggattacataaaggttgatcacccacgctctacagatgaacaaattgagacccagagatgctaaactgctctgcaggtcacaaacctgaacagcagcatagccaaaatgggaacggagctcttctgacttcaagcccctgcacttttttcttaaccacattaattttatgaatatctatgtggtcaaagtctcttttgtaaaatctgagtataagctgaactagatcatgtctctgtaagctaagatggcagaaacacattgtcatgttagtttggaggagcaaacagatataagtatgtgttgtaatgttatagtgagctgttatgtatcccccagcaatgtccaaagtgatcagagctactagatgacttattacaatgttcagatcccactccttcattcctcctctctcagtgacctgtctacccccaagctttagaactgagctctctccaacttagaactcattagagtttgttgcattagtgattggatctcctcatgaaagttttttgaccaatgacagtagagcccctttaagctagccaggcccaagatagggaagcactgctggtttacatttctgctctttctaattcagttgtctattgcatgcagacatcccctgcccgacttctccattatggaaggctaaggccatccttccttgtccagtttctctacctacacactaacatgccttttccccatggagtgaactctgccagttgtctttggacattttctgcagatgcaggctcagttctgctcttttgttcccacccacttctagatcttcctccatttaatcccttattcttataaggagtctaatttttgtgtattgtccttgattagggcagctgacagctttacaccaaagctgaagtctctcacttaatcctaagcaaggggctagggagaactaagatatccttcccatatcaagggatataggttactagaagggtggaggtctcttaacaggctcactcacctttcagagtttaaattatggtcaggcttaagaagctctctcttgtgactgagtgtattgcatagacatgtctgtgaaaataaaagcacccattttgctaagg

SEQ ID NO: 1498 - DNA, 873 bp, Homo sapiens
gagacgccgaatcttggtacttacgttcctgccgggcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcccatcacaagaaatactcgaagccggtgttggtgtattcctggcaccgtgacagagaagcttttcccaaaggttatgatatagagggtcctgagaaagttaaaaaactgtgtaattcaacatatcggcgactgggaaccgatgaatccccaatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttctatcttaataaatgcaatggaagtgttactata

SEQ ID NO: 1499 - DNA, 4148 bp, Homo sapiens
gacccacaggtgtcgctgcccctccaggccgaagctggcccaggaggcccctggcccaccccctcgccctgggaggcgcatttcctgcttggagtctcaggccccagcgtctggcacaggcaggggcctgcggagctgagggcagtggaccagctgcagggagggcgacctgtatgcggagcgccgttcctgcgacatggaccgcggccagcccagcctggagcctgctgccgcggccccccgagcctcgggccggtgcgtgatcgcgcccgtgcgcgctgtgctccgcctgcgccgccgggtgtgtgtcctacgcaaacggcgcctcctgcagccgggtggggggcccgacgtcgggaccggggcgcccaggccgggctgcagcccccgggcaccgcgcgcggacctggaccagccaaagttcttcaccttcgacagccccgcggagctaccctccaggacgccacgcaagaagcgccggcgcagccgcctggtgctttacccggagacctcgcgcaagtatcggccgcgcgtggagcacaggagccgcgcgcagcgctgccttctgctgctagtcgccatcgtgggcttccaagttctcaacgctatcgagaacctggacgataacgcgcagcgctatgacctcgacgggctggagaaagcgctgcagcgcgcggtgttcggccagcccgctgccgtatcgcgcatcgtggcgctgatgcgggactacctggccacgcatgtgcacagtcgtccgctcctcctggcgctgcacgggcccagtggcgtgggcaagagccacgtgggccgcctgctggcgcgccacttccgctcggtgctggaggacagcgcgctcgtgctgcaataccatgcgcggcaccactgccccgaggcgcgcgccgcacaggactgccgcgaggagctggcgcggcgcgtggccgacgtggtggcgcgggccgaagcggaggagaagaccccactcttggtgctggacgacgtggagctcatgccgcggccgctgctggacgagctgcacggcttcctgcagccgcagcgctcccaccacttccacaacgccatctacgtgctcctcagtggcgcgggtggcgccgaggtcacgcgcttcgtgctgcagaacgcgtcccgcgcgctgcccctgcgccccgacggcttccgcagtgccgaggccgcagcggcgcaggcggaagaagacctgcgcgccagcctgctggctgtgctgtcccgggagcatccgctgtggcaggccgcggccatcgtgccgtttctgctgctggacaagcgggatgtggtcagctgcttccgggacgagatggcgggtgagggcttctttcctgaccaggcccgcgcggagaacctggccgcgcagctcagcttctaccgcgtggctggccgcgagtttgccgtcaccggctgcaagcaggtggtggccacggtgaacctcctgtagtggaggcgcaggacgggacgtttgggttgatggcggcagtaggagggcgaccagggaccttgtgggctggtgcaggcccctgaggtttctagtgaatttgtggctgcccggctggtgggtgcggatcagcttggagctctgcttccaggtccacacccgcctcagagtccggagtctgtccctgggggcggcaggacagcagccacctccctcccaaacttgcccattgccctgctgggcgtcccaggcatggtctggtgcgttctccctgtggccccaagaggtgggttcccatggtacaaggatgatctcagggccaacaattcccggggtcacacagctgggacgtgaccccgcctcttgggggtggtcgcgtgttgctcagtgctgaagtggggttctcattccggcccccctggagatgaccccggaggaggccacagccaaccatgacagtgctggggctctggctgccttctccacccaccccacccctcactcaggtcgtgttttcaggagctcaaggctggagtgtcttgacagtaaggggaggggagcggaggcggaggcgcctcaggcagcctctccccctccttcctggaccccccaaccccgggcccgccagccctggcttgggcttactgggtgaccgagagcccgcggggcaagcgggaggtgcctaggcctctccccatccccctcttctccgcacgtgggacccttagcccgtggccagtcccctggtcaccacgattgcgcgacctccctttccctggggccttttgtgccccgagttccgcccacccgcaccctctgcgcagagcgccctccccacgccagtcgaccccacaccccacactccccacgcgccgcctcccggaagccctcctggacgcctcccgtggatgggcccaccgcgcccacgggggctttaggggaaggtgctttgggcgttttttgcgccatgtctcctcggggccggcggttgcctcgggacggttctcgcctcctcccacagccccggtgtctgggacgcacccggcagccccgctgctgccgccttgtggcgcgcccggcccagccggtggcttctgtggtcgccgggggctgagcgcgcggctgggccctgagtcccccaggccgccccgatcctctgtccccgccgccggccccgctgcagtcccaacccgggcctgcccgggaggagcgcaggggcggcgatgaccagtcccgaaaggggctcagagggcagcgaggaggtttcacgccggtgcggggcgccgtcgaggtgggggcaccgcgaaggtggaggcggggccgcgccggaagccccgagtcgagcgcacacggcgggcgcccctggcaagtgggactcctccggccccgaggcctgaactcagcccggagaccgcgcccaccagcgccggtgtccccggaggggccccgctagttccctgagcagaggtcctgcggcttcccggagggtgtcctgttctctcccccgcctcgcatccattctcgccctggtggttggtgtctgtggtcgggggcgagggccgtctagtggagacggggattcaggccgcttgaaagtctgggatctctgggcggatggcagcggctccgcggagctcgagctcggcgcgcaggtcctgggcccagggcgggagcgctagcgagagggctgccccgtcctgcccagagggtcctgaggactcccgctgctcctggagtcttggggaggggtccggctccacggggtgggggtgggggctaccaggaaacctttgcctcctggggctgtgcaggaccggctagccagcgctgggaaccagggctgagttcagcccagctctgtccaccccaaccccagggctaggggaaggagctgggagaaggagccccacctctcccaggcgagtatctgtcccaggagcccacacagagggacacccagctctggtctggccttcgtgttggcttcaaggtggtaacagagagagctgcagagtgggggtgtgtttgccagtccctgcatgggtgaatgttggggtgcccactgctccccaggcaggacccccaggactgtcagctccccttcccacagagcacccacctggaggtgtcacctgccggcaagcgtgggccattcatccacctgtcagtcaacaacacccgctgagcatcggcttgtatcaaaaggtccagacctaaggggaaattttatctctttctttctttctttcttttttttttgacacagagttttgctcttgttgcccaggctggagtgcaatgacacgatctcggttcactgcaacctctgcctcctgggttcaagcgattctcctgcctcagcctcccgagtagctgggattacaggcgcccgccatcacgcccgggtaatttttttgtattgttggtagagacggtgattcactatgttggccaggctagtcacgaactcctgacctcgtgatccgcccacctcggcctcccaaagtgctgggattacaggtgtgagccaccgtgcccggcctctttttatttattcctaaaatattaccttgaggccaaattctgcgcttaaggagaatgtgcaccaagtgctggggtgggggctggtaataaacgaggccacaaatcatgcttgttaataaattgtgtggttcaaatctga

SEQ ID NO: 1500 - DNA, 6269 bp, Homo sapiens
cagctctggcagaagcaacggtggcttcgagggatggcggcggctgcaacaggacctgcagcatcccagaggaactgactaaggctttggaacagaaaccagatgatgcacaatattatcgtcaaagagcttattgtcacattcttcttgggaattactgtggtgcagatgctaatttcagtgactggattaaaaggtgtcgaagctcagaatggctcggaatctgaggtgtttgtggagaattatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatgaaagcgttccacaacttcaactactttctgttcttctacaacgtgctgctgggcctgggtgcctgcctttccaggctgctcatcagttgcctcctcggcatgtggctgattgcccgcatcgacaggaccatcatgcagagtggctatgagggagcagacatggggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacaaatccttcgagactctggcagatcagacagagtggcagagttcacacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaattgttttcagagggaggcaacttttctcctaaagaaatcaattcactgtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggtggcaaaatccaattcgcaaacaaatggattaaatttctctctgcaacagcttcagaacaagataaaaacttgtcaagagtccaggggagagaaaaccacagtgaccacagaagaactcctcagcttcgtccaaacttggaaggaaaaactgagccagaggattcagtaccttaactgcagcctggacagggtgtccatgactgaactggtctttaccaacaccatcctgaaggaccaggaggaagacagtgacatcctgacatcttcagaagcccttgaagaggaggccaagctggacgtggtcacccctgagtccttcacccagctgagccgcgtggggaagcccctgattgaggacccagctgtggatgtgatcaggaagctcctgcaacttcccaacacaaaatggccaacccaccattgtgacaaagatccgtcccagacaggcttcaagcgacatcggtgccagccagaaaactctgggaagaaggctgtacccagtgccagtgctacctctgcaggcagcctccagaccacccacccacctttgtcccacagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacagactccttccctgtccatctacctgcctacctactttccgtccatccctccctcccttcatccctccacccctgctctgtgccgggcactgtagctttaccagcgaacaggacacagcatggtccctgcccacgtggagccctcttcccatgaggaaggcaagcatgaaaggggaattccacgtggttagcagggagggtgagtaccaggaatcagtcacttcaaataggcaccagagcttcaaaggacatcacctccaaacagcatgctgggcagggcacgtcatcttgaaaaatgaaataaaggtcatgggaaaatgatattttaatttaacagaataaacaagtatgggttat

SEQ ID NO: 1501 - DNA, 6851 bp, Homo sapiens
cagctctggcagaagcaacggtggcttcgagggatggcggcggctgcaacaggacctgcagcatcccagaggaactgactaaggctttggaacagaaaccagatgatgcacaatattatcgtcaaagagcttattgtcacattcttcttgggaattactgtggtgcagatgctaatttcagtgactggattaaaaggtgtcgaagctcagaatggctcggaatctgaggtgtttgtggagaattatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatgaaagcgttccacaacttcaactactttctgttcttctacaacgtgctgctgggcctgggtgcctgcctttccaggctgctcatcagttgcctcctcggcatgtggctgattgcccgcatcgacaggaccatcatgcagagtggctatgagggagcagacatggggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacaaatccttcgagactctggcagatcagacagagtggcagagttcacacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaacttcgagctggcttcttcgagcaccttgagaagtggtttgaccagtgttccctcaacacccgggtcaccgtggccaccaaaatcaatgagctggattcagaactggagctgcatctgcacctgcaccagccaagagcccagcagattgaaaaagacatccacaacgtcagggcagccgagcttttgcttcatcaagagcagttggacagccactgtgctggggtgaccgagacgctgaagaagaagcggctgatgttctgccagttccaagaagagcaaaacgtgaggagcaaaaacttccgccttaagatctatgacatggagcacatcttcttgaatgccaccaggagccaaaagctggtcactctcagcaacacactgcaccaggagttgcttagctatgttgatgtcacccaggtgtccctgcgcagcttccggcagtacttggaggagagtctgggcaaactccgctactcaaatattgagttcatcaaacactgcagattgttttcagagggaggcaacttttctcctaaagaaatcaattcactgtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggtggcaaaatccaattcgcaaacaaatggattaaatttctctctgcaacagcttcagaacaagataaaaacttgtcaagagtccaggggagagaaaaccacagtgaccacagaagaactcctcagcttcgtccaaacttggaaggaaaaactgagccagaggattcagtaccttaactgcagcctggacagggtgtccatgactgaactggtctttaccaacaccatcctgaaggaccaggaggaagacagtgacatcctgacatcttcagaagcccttgaagaggaggccaagctggacgtggtcacccctgagtccttcacccagctgagccgcgtggggaagcccctgattgaggacccagctgtggatgtgatcaggaagctcctgcaacttcccaacacaaaatggccaacccaccattgtgacaaagatccgtcccagacaggtagaggcgcatgggcctgtgggtctcggggcagcagtgaggcaggggctggtggtgctgtgtgctcacctcctgtcctctgctcctgtcctgggccctcgtcacccaaaggcttcaagcgacatcggtgccagccagaaaactctgggaagaaggctgtacccagtgccagtgctacctctgcaggcagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacagactccttccctgtccatctacctgcctacctactttccgtccatccctccctcccttcatccctccacccctgctctgtgccgggcactgtagctttaccagcgaacaggacacagcatggtccctgcccacgtggagccctcttcccatgaggaaggcaagcatgaaaggggaattccacgtggttagcagggagggtgagtaccaggaatcagtcacttcaaataggcaccagagcttcaaaggacatcacctccaaacagcatgctgggcagggcacgtcatcttgaaaaatgaaataaaggtcatgggaaaatgatattttaatttaacagaataaacaagtatgggttat

SEQ ID NO: 1502 - DNA, 1847 bp, Homo sapiens
aagcgcgctagtagcagctctggcagaagcaacggtggcttcgagggatggcggcggctgcaacaggacctgcagcatcccagaggaactgactaaggctttggaacagaaaccagatgatgcacaatattatcgtcaaagagcttattgtcacattcttcttgggaattactgtggtgcagatgctaatttcagtgactggattaaaaggtgtcgaagctcagaatggctcggaatctgaggtgtttgtggagaattatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatccttacaatatccatcgttgtgggtctcatgatcctgcagatgtgtatcgctgccagcttcttcctacagccaaagctgggcacggctgacaagcagaagcccctggctctcaacaacaggaaagcgttccacaacttcaactactttctgttcttctacaacgtgctgctgggcctgggtgcctgcctttccaggctgctcatcagttgcctcctcggcatgtggctgattgcccgcatcgacaggaccatcatgcagagtggctatgagggagcagacatggggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcaggtccccatgtctcagctaggtccagaacaaggtggttcctgttgcagaccctaatcgacaacccaagactcaccatgcacagaaaattaaaattagggcacagttcccaggagtcccaaattctgatggcatgctcggagagctgacgctggcccccatcatctgctccaaagccaggctaggacatctgccaccaagagagggctcaatctaaccagcagctgtcccctgcaatgaaatgggatggcacaggcaccatccatgcagatggcagacaacaatggtcactcatgggatggccacctgggctgagggatgaagtttcaggactatttcactcccttggcaaaaaagattaaaaaactaaagaaaagtctgttg

SEQ ID NO: 1503 - DNA, 6184 bp, Homo sapiens
cagctctggcagaagcaacggtggcttcgagggatggcggcggctgcaacaggacctgcagcatcccagaggaactgactaaggctttggaacagaaaccagatgatgcacaatattatcgtcaaagagcttattgtcacattcttcttgggaattactgtggtgcagatgctaatttcagtgactggattaaaaggtgtcgaagctcagaatggctcggaatctgaggtgtttgtggagaattatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatgaaagcgttccacaacttcaactactttctgttcttctacaacgtgctgctgggcctgggtgcctgcctttccaggctgctcatcagttgcctcctcggcatgtggctgattgcccgcatcgacaggaccatcatgcagagtggctatgagggagcagacatggggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacgtgcgtgctggggactgttccactggggagctgagaaatccttcgagactctggcagatcagacagagtggcagagttcacacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaattgttttcagagggaggcaacttttctcctaaagaaatcaattcactgtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggtggcaaaatccaattcgcaaacaaatggattaaatttctctctgcaacagcttcagaacaagataaaaacttgtcaagagtccaggggagagaaaaccacagtgaccacagaagaactcctcagcttcgtccaaacttggaaggaaaaactgagccagaggattcagtaccttaactgcagcctggacagggtgtccatgactgaactggtctttaccaacaccatcctgaaggaccaggaggaagacagtgacatcctgacatcttcagaagcccttgaagaggaggccaagctggacgtggtcacccctgagtccttcacccagctgagccgcgtggggaagcccctgattgaggacccagctgtggatgtgatcaggaagctcctgcaacttcccaacacaaaatggccaacccaccattgtgacaaagatccgtcccagacaggcttcaagcgacatcggtgccagccagaaaactctgggaagaaggctgtacccagtgccagtgctacctctgcaggcagcctccagaccacccacccacctttgtcccacagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacagactccttccctgtccatctacctgcctacctactttccgtccatccctccctcccttcatccctccacccctgctctgtgccgggcactgtagctttaccagcgaacaggacacagcatggtccctgcccacgtggagccctcttcccatgaggaaggcaagcatgaaaggggaattccacgtggttagcagggagggtgagtaccaggaatcagtcacttcaaataggcaccagagcttcaaaggacatcacctccaaacagcatgctgggcagggcacgtcatcttgaaaaatgaaataaaggtcatgggaaaatgatattttaatttaacagaataaacaagtatgggttat

SEQ ID NO: 1504 - DNA, 4064 bp, Homo sapiens
cagctctggcagaagcaacggtggcttcgagggatggcggcggctgcaacaggacctgcagcatcccagaggaactgactaaggctttggaacagaaaccagatgatgcacaatattatcgtcaaagagcttattgtcacattcttcttgggaattactgtggtgcagatgctaatttcagtgactggattaaaaggtgtcgaagctcagaatggctcggaatctgaggtgtttgtggagaattatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatgaaagcgttccacaacttcaactactttctgttcttctacaacgtgctgctgggcctgggtgcctgcctttccaggctgctcatcagttgcctcctcggcatgtggctgattgcccgcatcgacaggaccatcatgcagagtggctatgagggagcagacatggggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacaaatccttcgagactctggcagatcagacagagtggcagagttcacacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaccgggcatggtggtgtgtgcctgtaattccagctactcaagaggctgaagcaggagaatcgcctgaacccaggaggcggaggttacagtga

SEQ ID NO: 1505 - DNA, 5242 bp, Homo sapiens
gagcgccgttaacttttccccgaagagcatggcagagtgaagcacaagcaataatcctgtattattcgcgttcccagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacaaatccttcgagactctggcagatcagacagagtggcagagttcacacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaacttcgagctggcttcttcgagcaccttgagaagtggtttgaccagtgttccctcaacacccgggtcaccgtggccaccaaaatcaatgagctggattcagaactggagctgcatctgcacctgcaccagccaagagcccagcagattgaaaaagacatccacaacgtcagggcagccgagcttttgcttcatcaagagcagttggacagccactgtgctggggtgaccgagacgctgaagaagaagcggctgatgttctgccagttccaagaagagcaaaacgtgaggagcaaaaacttccgccttaagatctatgacatggagcacatcttcttgaatgccaccaggagccaaaagctggtcactctcagcaacacactgcaccaggagttgcttagctatgttgatgtcacccaggtgtccctgcgcagcttccggcagtacttggaggagagtctgggcaaactccgctactcaaatattgagttcatcaaacactgcagattgttttcagagggaggcaacttttctcctaaagaaatcaattcactgtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggtggcaaaatccaattcgcaaacaaatggattaaatttctctctgcaacagcttcagaacaagataaaaacttgtcaagagtccaggggagagaaaaccacagtgaccacagaagaactcctcagcttcgtccaaacttggaaggaaaaactgagccagaggattcagtaccttaactgcagcctggacagggtgtccatgactgaactggtctttaccaacaccatcctgaaggaccaggaggaagacagtgacatcctgacatcttcagaagcccttgaagaggaggccaagctggacgtggtcacccctgagtccttcacccagctgagccgcgtggggaagcccctgattgaggacccagctgtggatgtgatcaggaagctcctgcaacttcccaacacaaaatggccaacccaccattgtgacaaagatccgtcccagacaggtagaggcgcatgggcctgtgggtctcggggcagcagtgaggcaggggctggtggtgctgtgtgctcacctcctgtcctctgctcctgtcctgggccctcgtcacccaaaggcttcaagcgacatcggtgccagccagaaaactctgggaagaaggctgtacccagtgccagtgctacctctgcaggcagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacaga

SEQ ID NO: 1506 - DNA, 4986 bp, Homo sapiens
gggcgtccagctgcagttgtcgctggaccggccctggctgccttgagagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacaaatccttcgagactctggcagatcagacagagtggcagagttcacacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaattgttttcagagggaggcaacttttctcctaaagaaatcaattcactgtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggtggcaaaatccaattcgcaaacaaatggattaaatttctctctgcaacagcttcagaacaagataaaaacttgtcaagagtccaggggagagaaaaccacagtgaccacagaagaactcctcagcttcgtccaaacttggaaggaaaaactgagccagaggattcagtaccttaactgcagcctggacagggtgtccatgactgaactggtctttaccaacaccatcctgaaggaccaggaggaagacagtgacatcctgacatcttcagaagcccttgaagaggaggccaagctggacgtggtcacccctgagtccttcacccagctgagccgcgtggggaagcccctgattgaggacccagctgtggatgtgatcaggaagctcctgcaacttcccaacacaaaatggccaacccaccattgtgacaaagatccgtcccagacaggcttcaagcgacatcggtgccagccagaaaactctgggaagaaggctgtacccagtgccagtgctacctctgcaggcagcctccagaccacccacccacctttgtcccacagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacagactccttccctgtccatctacctgcctacctactttccgtccatccctccctcccttcatccctccacccctgctctgtgccgggcactgtagctttaccagcgaacaggacacagcatggtccctgcccacgtggagccctcttcccatgaggaaggcaagcatgaaaggggaattccacgtggttagcagggagggtgagtaccaggaatcagtcacttcaaataggcaccagagcttcaaaggacatcacctccaaacagcatgctgggcagggcacgtcatcttgaaaaatgaaataaaggtcatgggaaaatgatattttaatttaacagaataaacaagtatgggttat

SEQ ID NO: 1507 - DNA, 2327 bp, Homo sapiens
aggttcgaatctccgccgcttcgcggttgcttctcaacgtccgggccgcatctcggcggcggcgagggctgagcgcgggagctgcctccgagccggagccccagccctaggccctgcgcgagctgccccgccctaccccctccagcgtcctgtcgcctcctcgcccgacttcggcctgtccctctctcacgcgctcagtcctcgctcttcgccccccgcagctatcggcactcggtctcccgcgcctggcgggctccgcccgagcctctgggcccatggccaagcggcgtgcggccgagccggtgacgttccacgtgccttggaagcggctcctgctttgcgacttcgctgagcagccgccgccaccgcctctctggatccggccgcccggggtcgcgcatgctgggcagctcctcggcgtcccagagcagcaccgaaagcgcaaaatcgacgcagggaccatggcagagccctcggcttcgcccagcaagcgccgtgacagcggggacaacagcgccccgagcggccaggagcgtgaggaccacggtctggagacaggcgatccgccgctgccgccgccgcccgtactgccggggccgggggaggagctcccgggcgcccggctcccggggggcggtggcgacgacggggcggggcgcgcaggacccccgcggggagactggggggtcgcatcgcgccagcacaatgaagaattttggcagtataataccttccagtactggaggaatcctttgcctcctattgatctggcagacattgaagatttaagtgaagacaccctgacagaagcaacacttcagggcaggaatgaaggggctgaggttgacatggagtcctgatgtaaggagccgaagcagtgggattggctgatttgaggagatgtctctaagtgaattctcgtattcttaagggaaaagttattttccatacttgaagttatatttccaaacctgagaaatgaagaaagattgttctgacattaaatacctacagttactactgaacctcttaataaggatttgtcaaggatagagtacagttgtaggggaagtattttatgtatgcattcttagagcaaaaagttttgtttaaattctagaattgaaggtactgatcttataaaaagaaattctagcagttttagaaataggtgggaaaaactcaaatattcctcctatctgcaccaaaaagtttatttgtggtatataaaatgaatattgttttataataacttgttaataaagtactttctaatacattctattgactctgttagttgaacaaatagctgacttgaacatctatgcaaacttaagatgggcgggattgttgtaaaagctattgttttaaaagagctttctaaatgtaaagtagtgataatttcaatttgggtagcgtgtttgcaaagcttccaatatttgatgttggttaagctctactatgggcaactgaagatggataaagaaaaatgaaaactgaatcggtgcctgcttccccctgttttcccaggattagaggaaaaaatttattgtataatcagcttcttggttttgaattgcttcgaggcatggttttattccttattactttagacctgtagttttcaacactgacagcactttaaaaatctttgcctgggcctcactcttgagagattctcatttaatagttctgaggtgggtcttggatataactatttttttaaacacctgtcctgtttccctccattcctctcatgtgcagacagggttgagaaccagtagactaatggtcgtttttcctgtttaaaggagataactaatttgagctgaagcaatgcttcttaattagctttgtttttgttttgctctgttggtggctttgttacaactgaattattgtgttattactatttcattgttaaagaaataaagtaagcaatttgtgatgtgagtatcagtgattaagttaactaacttttgtactgcatccagaatgttggttttgcaattgagtaactggttcttgcttgcattttttgttgttgatgacattagatccaaaattcaagacaaatggtaaatgccattgagagggaaagagaaaaacttgattttttttgtgtaatgaaggatttaagaatgggttgacattaataagaatgctttagaacagaagacaaactgtattgcattgtggtcagacatggttcaaagtcttgtactgccacttcctacctatgtatctttaagccagttatttttcatctccaagcctcaaatttctcacctgtaaaatgagaaataataaatagtatctacctcaga

SEQ ID NO: 1508 - DNA, 932 bp, Homo sapiens
gagcgaggcccggtccctgcagcgggcgaaaggagcccgggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctgg

SEQ ID NO: 1509 - DNA, 1502 bp, Homo sapiens
gctttcagttgtaacggacttcatcacatcacaaattgtactcgttctcatccttttaagaaagttcagacccaggaaaatttccatagtaccttaatgaaaaagatagaaatcagtgggacgtgtctttcctttcatctccttttcggcttggaaatcagaatgagaaggattgtttttgctggtgttatcttattccgcctcttaggtgttatcttattccgcctcttaggtgttatcttattcggccgcttaggtgacctgggaacctgccagacaaaacctggtcagtactggaaagaagaggtccacattcaagatgttggaggtttgatttgcagagcatgcaatctttcactgcccttccatggatgtcttttagacctgggaacctgccaggcagaacctggtcagtactgtaaagaagaggtccacattcaaggtggcattcaatggtattcagtcaaaggctgcacaaagaacacatcagagtgcttcaagagtactctcgtcaagagaattctgcaactgcatgaacttgtaactactcactgctgcaatcattctttgtgcaatttctgagtcagtggcccatatctaaaatgcttggcagatcaatcagtctcgaagcctgacctggctatcacaaaatgatggctattgtcaattagcccacttcagaaacctcagacccttgtaggtagaaggaattttgatctgaaattgactttggttttcaatattcccaatatctcccccaccacctccaactcatctgagaaatagccctttcaacaccatttctctcctctcctccttctgcttaatttaccttcctaccacaaggctacaaagaaggaaaaatgttagtgattctccaagtcaaactaggcatgtcacctctaactactttcatttccctcaataattccatactccaaaatatggttacaaatgtttcacaagacagcaagtgacctgagaatattcatttggtttccaaagcaaactgccttgctcctttggggtgatttatggtatagaagaaactgacttaacatatactatagggaaaaaataagccatgaatcagcaagccaggcctgcgggaaaagtatgaacccaaacaggaaagggctgaggcaggtggtagggctggcacttatttcttccatctgcctcagagtttatccaaattttgaattttccgtaccttaaccatgcctaaatgctttggcttgttcaattttggcagattaagcagttcaaggtaagcagagaagtaagttcccaaccacaaggaatttaaaaggagtaggaacgtactttgaactacatttcccattttgcgatcattacgtcttctattacaatgccctactttggcagcatgaagagtactgcattaatttaatttaatttaaaatttaatttaaaactgtctttctctgtattttcaggagtttgaaaattcaaaaaataaataataaatgtcaataaaa

SEQ ID NO: 1510 - DNA, 1000 bp, Homo sapiens
cctccccacactaagctcgagtgtcccaggtcgacttcagactgctgtgctggcagcaagaatttcaacccagtggatcttaacctgttgggctccatgggggtgggattcactgagctagaatacttggctccctggcttcggccccccttttcagacctgggaacctgccagacaaaacctggtcagtactggaaagaagaggtccacattcaagatgttggaggtttgatttgcagagcatgcaatctttcactgcccttccatggatgtcttttagacctgggaacctgccaggcagaacctggtcagtactgtaaagaagaggtccacattcaaggtggcattcaatggtattcagtcaaaggctgcacaaagaacacatcagagtgcttcaagagtactctcgtcaagagaattctgcaactgcatgaacttgtaactactcactgctgcaatcattctttgtgcaatttctgagtcagtggcccatatctaaaatgcttggcagatcaatcagtctcgaagcctgacctggctatcacaaaatgatggctattgtcaattagcccacttcagaaacctcagacccttgtaggtagaaggaattttgatctgaaattgactttggttttcaatattcccaatatctcccccaccacctccaactcatctgagaaatagccctttcaacaccatttctctcctctcctccttctgcttaatttaccttcctaccacaaggctacaaagaaggaaaaatgttagtgattctccaagtcaaactaggcatgtcacctctaactactttcatttccctcaataattccatactccaaaatatggttacaaatgtttcacaagacagcaagtgacctgagaatattcatttggtttccaaagcaaactgccttgctcctttggggtgatttatggtatagaagaaactgacttaacatatactatagggaaaaaataagccatgaatcagcaagccagg

SEQ ID NO: 1511 - DNA, 1245 bp, Homo sapiens
cagggaagcagaggagcagcagggtcagggtgctgggttcctaaggtgcaaggatgcagaacagaactggcctcattctctgtgctcttgccctcctgatgggtttcctgatggtctgcctgggggccttcttcatttcctggggctccatattcgactgtcaggggagcctgattgcggcctatttgcttctgcctctggggtttgtgatccttctgagtggaattttctggagcaactatcgccaggtgactgaaagcaaaggagtgttgaggcacatgctccgacaacaccttgctcatggggccctgcccgtggccacagtagacaggccagacttttaccctccagcttatgaagagagccttgaggtggaaaagcagagctgtcctgcagagagagaggcctctggcattcctccacctctatatacagagacgggcctggaattccaggatggaaatgactcccacccagaggccccaccatcttatagagagtccatagccggcctggtggtgacagcaatctcagaggacgcccagaggcgaggccaagagtgctgaggcagagaaagctctccagcactcatgatgccaccactgtggggagcagctactgataataaaggcaaacgagggactgtgggaggaaaagccacaccagggaccccacaagagagcttggggaggggatgacagccctgaattccagacataactggccatgccagggcagggcaggccaggggccctggaagggtgtggccaacaccaagcagacatttcagagcattcacactaatcttaaccccggctggccttgggtccccaaaggtgtcactctgagagctctgcttacagagattctttctgctgtcactcaatttccctcccatcacctcaactccagccagggaggaatagatgctggttgtcaggacagccacatgccttcctgttctatatcacctagtaatctcaaagcgaaggtttgttgtttaatttattgattgttcagccttttgttttgttagcttgtttcctagttacctccagctgaccatactaccagagtgaggcagtacttcacatcctgggagatatgccctcggaacccatgaatgttattttgtattattttattttcatgatatgtattttttctatgtaaaaggaaaatgactgtaatatttgccttcaagatggttcaaacacaaaatattaaatgagctgtttcttaaaa

SEQ ID NO: 1512 - DNA, 4478 bp, Homo sapiens
gatacaagcctgggccccagtccctagtcccaaaggggatgcccagagctcagttgcttgaaggcgatgggaaatctcgtcatccctctagggaagggcagggcaggcagggttgagagtgggcagaggattccacccccagctcccagaccatctgtggagtgcacaggagacgacattgcacttcagatggagaaaatgctctttcctctgaagagccctagtgccacatggctgagccctagctccactccctggatgatggatttcatcctcaccagtgtgtgtggcctagtgctcctcttcctattgctcctctacgtccacagtgacccaccctcacccccgcccgggaggaagaggagcagcagggagcctcaaagggagagaagcgggaggtccaggagcaggaagatctcagctctgaaagcttgcagaatcctcctgagggagctggaggagactcgggacctgaactaccttctggaaagccacctgaggaagctcgctggcgaaggcagctcccacctgcccttaggtggagaccccctgggggacgtgtgtaaaccagtgcctgctaaggcccaccagccgcatgggaaatgcatgcaagatccgtctcctgccagcttgtccccaccagctcccccagctcctctggcctccaccctgtcaccaggcccgatgaccttctcagagccttttggaccacactcaaccctgagtgcctccgggccaccagagcccttgcttcccctaaaatgccctgcaacccagccacatgtggtttttcctccttcaccacagccgcatggtcccctggcctcctctccacctccacccgactccagcctggctggacttcagtgtggctccacaacatgccccgtcccccagagctcccctctacacaaccaggtgctgcctcctccaaccagggtgatctctggcctggggtgctccagcgatcccatctgggacctctattgctggagggaggctgccaccacctggggcctctccacctactcacatggcaaatcccagccacggcatcttcccgaccacacctcagaggcttccttctggggagaccccacacccaagcacatggaggtaggtggctgcacattcatccaccctgacgtgcagaagctgctggagaccctcatcgccaagagagcactgatgaagatgtggcaggagaaagaaagaaaacgggccgaccacccgcacatgacatcactggggaaggagtgggacatcacgaccctaaatcccttctggaacgtgtcaacccagccacagcagctgccccgtcctcagcaagtctctgatgccacaaccgtggggaaccacttacagcagaaacgcagccagcttttctgggacctcccctctctcaatagcgagtccctggcgaccacagtctgggtttctaggaacccttcctcacagaatgcacactctgtaccactggataaagcctccacttctcttccaggtgaacctgaggttgaggcatcctcacagctttcccaggcaccgccccagccccaccacatggcccagccccaacatttcactccagcctggccccagtcccagcccccacctttggctgagatccagacccaggcccacctctcaccccctgtcccaagcctggggtgctcttctccaccccagattaggggctgtggggcatcttaccctacatcccaggagaggacacagtctgtcatccccactggaaaggagtatcttgaatggcccttgaagaagcgaccaaagtggaagagggttttgccctctctcctcaaaaagtctcaggctgttctgagccagcccactgcccaccttccccaagagaggccggcctcctggagccccaagtcagcccccatccttcccggggttgtcaccagccctgagctcccagagcactggtggcaaggaaggaatgccatccaccaggagcagtcctgtggccctcccagcagattgcaggcatctggggacctgctacagcctgatggggaattcccagggaggccccagagtcaggcagaagacacgcagcaggccctcttgccctcccagccttctgactttgcagggaagggcaggaaggatgtgcagaagaccgggttcaggagctccggaaggttctctgacaaggggtgcttagggtccaaactagggccggacccaagccgggatcaaggctcaggaaggacctcagtgaaggctctggacgaagacaaggaggcagaaggtgacttacggaggtcctggaagtaccaatcagtaagttccacacccagggacccagacaaggagcatctggaaaacaagctgcaaatccatctggccaggaaggtaggggagatcaaagagggctggatccccatgcctgtgcgtcgctcctggctcatggccaaatgtgctgttcccaagtctgacacccacaggaaacctgggaagctggcatcctggaggggtgggaaagcccacgtgaacacctcccaggagctttccttcctccatccctgcacccagcagatactggaagtacatcttgtaaggttctgtgtgaggcacagctggggtacagacctccagtccctggagcccataaatgtctggtcaggtgaggctcaggccccgcccttcccacaatccacctttaccccctgggcctcctgggtatctcgggttgaatctgtacccaaggttcccattttcctgggaaaacgtcctcagaatggtccaggagacaacagaacaacaagcaagtcagtcccgaccgtgagtggccctctcgctgccccaccgcctgagcaggagggagtccagaggcccccgagagggtcccagtcagctgatacccatgggcgatcagaggcctttccgactggacacaagggcagggggtgttctcagcccccaacatgcagccttgtgggcagaacctggcagagcaggactgtcctggaatccgggaaacccaaacccagactagaggggagtatgggttcagaaatggctgggaacgaggcatggcttgagagtgagagcatgtccccaggagacccctgtagtagcagagccctgcaagtgctcagcatagggtcccagtgggcaagggctgaagatgccctgcaggcactgaaagtgggggagaagcccccaacttgggaagtcaccttgggagccagtgtgagggcaagttcgggaagtgttcaggaggatctgaggagcacaggggctctggggaccactggtaacccctcagcgtcttcagtctgtgttgctcaggatccagagcagctgcacctgaaagcgcaggtggtcagtgagattgcgctcatagtgcaggtggactcagaggagcagctgccaggccgtgccccgggcatcctcctccaggacggcgccacaggcctgtgccttccaggccgccacatggacatgctcactgccgcagacaggctgcccactcaagcccctctgtccacctcccagagtgtgtctggtaagaacatgacagcttcccaggggccatgtgccctcctatggaagggaggggacagtccagggcagcaggagcctgggagcccaaaagcaaaggccccacagaagagtcagaagacgctgggctgtgcggacaagggcgaggcccacaggaggcccagaacaggggagcagggacacaggtccaagggacccaggacctctgaagccagtgggaggagccaccctgcccaagccagggaaataggagacaaacaagaaaggaaatacaaccagcttcagctggagaagggacagacaccaccagaaagccacttccagagaaagatcagtcaccatccacagggtctacaccccaggaaaggaggcacacggtgggaagatgtcctgcagaaaggcaagcctggggcagatgctttccagagctgggggtctggcccaccaaggcagtttatggactgcatggctgacaaagcctggaccatcagcagagttgtgggacaaatcctggtggacaaactggggcttcagtggggacgaggtccctcagaggtcaatcgccacaaaggtgacttccgcgcccaggagaatgtgccttcctgctgccacaggggtcactgccaccaagaacgtagcagagagatgagagctctggcctgcagccctaaagccacccccaagggccaccactgtcctgtcaaaaacaggggcatcagagacagagacagcagttgggccccacctcccagggagcctgtgtccccagctggtccccaccaccacaggccaagaatggcaagcacctcgggcggcccccatccacagctgcaggaactgatgtctgcacagaggtgtcttgcctcctgaactagaccagtcttcttgcatgtctcctgggggagacagggggttctactcaaataaaactgatgcctacacaa

SEQ ID NO: 1513 - DNA, 2601 bp, Homo sapiens
gatacaagcctgggccccagtccctagtcccaaaggggatgcccagagctcagttgcttgaaggcgatgggaaatctcgtcatccctctagggaagggcagggcaggcagggttgagagtgggcagaggattccacccccagctcccagaccatctgtggagtgcctccgggccaccagagcccttgcttcccctaaaatgccctgcaacccagccacatgtggtttttcctccttcaccacagccgcatggtcccctggcctcctctccacctccacccgactccagcctggctggacttcagtgtggctccacaacatgccccgtcccccagagctcccctctacacaaccaggtgctgcctcctccaaccagggtgatctctggcctggggtgctccagcgatcccatctgggacctctattgctggagggaggctgccaccacctggggcctctccacctactcacatggcaaatcccagccacggcatcttcccgaccacacctcagaggcttccttctggggagaccccacacccaagcacatggaggtaggtggctgcacattcatccaccctgacgtgcagaagctgctggagaccctcatcgccaagagagcactgatgaagatgtggcaggagaaagaaagaaaacgggccgaccacccgcacatgacatcactggggaaggagtgggacatcacgaccctaaatcccttctggaacgtgtcaacccagccacagcagctgccccgtcctcagcaagtctctgatgccacaaccgtggggaaccacttacagcagaaacgcagccagcttttctgggacctcccctctctcaatagcgagtccctggcgaccacagtctgggtttctaggaacccttcctcacagaatgcacactctgtaccactggataaagcctccacttctcttccaggtgaacctgaggttgaggcatcctcacagctttcccaggcaccgccccagccccaccacatggcccagccccaacatttcactccagcctggccccagtcccagcccccacctttggctgagatccagacccaggcccacctctcaccccctgtcccaagcctggggtgctcttctccaccccagattaggggctgtggggcatcttaccctacatcccaggagaggacacagtctgtcatccccactggaaaggagtatcttgaatggcccttgaagaagcgaccaaagtggaagagggttttgccctctctcctcaaaaagtctcaggctgttctgagccagcccactgcccaccttccccaagagaggccggcctcctggagccccaagtcagcccccatccttcccggggttgtcaccagccctgagctcccagagcactggtggcaaggaaggaatgccatccaccaggagcagtcctgtggccctcccagcagattgcaggcatctggggacctgctacagcctgatggggaattcccagggaggccccagagtcaggcagaagacacgcagcaggccctcttgccctcccagccttctgactttgcagggaagggcaggaaggatgtgcagaagaccgggttcaggagctccggaaggttctctgacaaggggtgcttagggtccaaactagggccggacccaagccgggatcaaggctcaggaaggacctcagtgaaggctctggacgaagacaaggaggcagaaggtgacttacggaggtcctggaagtaccaatcagtaagttccacacccagggacccagacaaggagcatctggaaaacaagctgcaaatccatctggccaggaaggtaggggagatcaaagagggctggatccccatgcctgtgcgtcgctcctggctcatggccaaatgtgctgttcccaagtctgacacccacaggaaacctgggaagctggcatcctggaggggtgggaaagcccacgtgaacacctcccaggagctttccttcctccatccctgcacccagcagatactggaagtacatcttgtaaggttctgtgtgaggcacagctggggtacagacctccagtccctggagcccataaatgtctggtcaggtgaggctcaggccccgcccttcccacaatccacctttaccccctgggcctcctgggtatctcgggttgaatctgtacccaaggttcccattttcctgggaaaacgtcctcagaatggtccaggagacaacagaacaacaagcaagtcagtcccgaccgtgagtggccctctcgctgccacaggggtcactgccaccaagaacgtagcagagagatgagagctctggcctgcagccctaaagccacccccaagggccaccactgtcctgtcaaaaacaggggcatcagagacagagacagcagttgggccccacctcccagggagcctgtgtccccagctggtccccaccaccacaggccaagaatggcaagcacctcgggcggcccccatccacagctgcaggaactgatgtctgcacagaggtgtcttgcctcctgaactagaccagtcttcttgcatgtctcctgggggagacagggggttctactcaaataaaactgatgcctacac

SEQ ID NO: 1514 - DNA, 2314 bp, Homo sapiens
ggcgggaacccgtgccccaagatgccgtgcacgtggtcggctccgcgcggaggctccttccggcgtcccgggggggcgctcggctgatgaaacgcggcctccagctccgctccgccgcgggcccgggaggcgcgttccctcttggccccaaagcgagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaagagctccacaatggccaggtcctcactgttctccggattgacaatacctgtgcacccatctccttcgacctgggagccgcagaagagcaactgcaaacttggggcatccaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggctt

SEQ ID NO: 1515 - DNA, 4578 bp, Homo sapiens
ggcgggaacccgtgccccaagatgccgtgcacgtggtcggctccgcgcggaggctccttccggcgtcccgggggggcgctcggctgatgaaacgcggcctccagctccgctccgccgcgggcccgggaggcgcgttccctcttggccccaaagcgagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaagagctccacaatggccaggtcctcactgttctccggattgacaatacctgtgcacccatctccttcgacctgggagccgcagaagagcaactgcaaacttggggcatccagcaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttgtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaa

SEQ ID NO: 1516 - DNA, 3217 bp, Homo sapiens
tgtaaaaagtggatagtggctcacgtgtcaaaggatggcacggtcacgatctagatcccccaggtggaaacacaggtctttatcaccagtacctagaaatgctgaacactacaagcaaagacattcacacgggcattatggctgtgaatataggaaggatccaaaaagacccgtcgcgtggagaatggacagtgagaaacatggacagagtaaaccaaggattccctctcgtggaaatatatattaccagtcttatgaacatagatcaccttcccctaacataagaaactctttagaaaatgtttatatgtataagcctcacagaggatattcgcctggaagaggggacagtaacaggagagctcagtatatgcccaaatactcagagggtataccctacaaagagcatgaaaggaattcttatccccagaaagtgcaaggagggcatagtcctgatgaccacagagttagaggaagtggaaaaggagggaaaccacctcagaggtcaatagcagattcttttagatttgaaggaaagtggcatgaagatgagttgaggcaccagaggatacaagaagaaaaatactcccagtcaactagaagaggctctgaagactttgagacaaggagctcatttcagaagaggtatcctgaggatcgtgatttcagaaaatatggacacacatcaaaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaaggtaaagaatgttcatactgatggattccaaaaacccacacattttataaaatcaaattttagaaaatgtattgaaaaaccttacatgaattatactacgcagagaaaagacataattactcacaaaccatttgaggttgagggaaaccaccgaaacacaagagtaagaccttttaagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgctt

SEQ ID NO: 1517 - DNA, 1956 bp, Homo sapiens
aaaggcagagtcatcccaggctctcacagtggaattaataataagctcacttgccacctcagtttcaagtcatctaaacctgtgtcattttttaccaatcttcttttctgtgatgacagaaaaaactggttttcacttccagttactgcaacagcagaaaactgcattcttactatttacccatatatggcaattcatctggataagcaaaacattattttaaagaatgataaggatgaatatcttaagaagactagagatggtgttttgcctccctaccaggatgctaaaccaccctctcctgcttcaattaaaaagacatacaccactagcaaattcaatgatgctgaacctgcaaagggaaacttatttattggagtggaagtactgcctgaaaatttgcacttggatgaaagtgaaacatcagaggaagatcatgggtctctggaaaaggaaaaatatgaacaattcctttctcttgaggaaggaacaaaggcacactacttttttgagaaggttgtaaatgcagcacagacctggttcagtctctttggctggcctgaaggaccccattctttttctattccagagactataagaagggatgtatataaaatgcaattctactcatcaacctcgccaccccaaaagttttccagacagaatgacttttccaaatataataagaccatttatgatgtgctgctccatttgagtggaaaaatgccacctggaattaattcaagtcaatctttacctgtagataaccatgaaaaaagggtaattcaactccatttgcaacattcctcacttctggactttctcaatgctcaaggaggatgtatttcacatgtcctgccagaatttttgcttgaaccagaagattataagaggtggattgaaattatgtcttccactaatacgatgcctgtgagttcctgtacacctaagaaaaaatgttctattgttatagaaatgtctaaatttgaagcctggagtaaacgggcatggacagatgtatttctacagatatacaaggttttggttctatcccgtgtagtgccatactgcagcaataatatgccccccatatgtgtgcaaaatacaccaaaagtcaatccttgttttgcatccagcaacatatattctgattctgaaagaattttgcttagttggatgaacataaattatgagaatactcgacatgtgatatggaaaaactgtcacaaagatgttatcccttctgagagatggatagtaaattttgacaaagacctttcagatggtcttgtttttgcaacacagttgggagcctattgcccattcttgattgagtctcattttataaatatgtacacacgaccaaaaagtcctgaagagtatctgcacaattgcctgattattgtaaatactctttatgaaattgactttgacgtggaaatacaggtgtgtctgagggtgtttccaaaggagatggatgcaggagtcagtggcctgagaaaggaagatatgccctcagtgtgggttgttaccatccgattggctgtggcagtggccagaacaaagagacagaagaagggggatattcagtttgcttgtttttttgtttgtttgttcttttttatttttgtcgtgatctctttctccctttggagcaggatgcatttttttctccttctgcccttggacatctgattccaggtttttcagcctttggactctaggacttgcaccagcagcctcctttgggctttcagccttcggcctcagaatggggcctgcactgtagcttccctggtttgggggatttgggacttggcctgagccatgcttctggcttccctgggagcccctattggcttctgtcattctgcagtttgtagccagcctactgtgggacttcgcctttgtgattgttcagccaattcttcctaataaattcccgtttatatatat

SEQ ID NO: 1518 - DNA, 1958 bp, Homo sapiens
aaaggcagagtcatcccaggctctcacagtggaattaataataagctcacttgccacctcagtttcaagtcatctaaacctgtgtcattttttaccaatcttcttttctgtgatgacagaaaaaactggtgttttcacttccagttactgcaacagcagaaaactgcattcttactatttacccatatatggcaattcatctggataagcaaaacattattttaaagaatgataaggatgaatatcttaagaagactagagatggtgttttgcctccctaccaggatgctaaaccaccctctcctgcttcaattaaaaagacatacaccactagcaaattcaatgatgctgaacctgcaaagggaaacttatttattggagtggaagtactgcctgaaaatttgcacttggatgaaagtgaaacatcagaggaagatcatgggtctctggaaaaggaaaaatatgaacaattcctttctcttgaggaaggaacaaaggcacactacttttttgagaaggttgtaaatgcagcacagacctggttcagtctctttggctggcctgaaggaccccattctttttctattccagagactataagaagggatgtatataaaatgcaattctactcatcaacctcgccaccccaaaagttttccagacagaatgacttttccaaatataataagaccatttatgatgtgctgctccatttgagtggaaaaatgccacctggaattaattcaagtcaatctttacctgtagataaccatgaaaaaagggtaattcaactccatttgcaacattcctcacttctggactttctcaatgctcaaggaggatgtatttcacatgtcctgccagaatttttgcttgaaccagaagattataagaggtggattgaaattatgtcttccactaatacgatgcctgtgagttcctgtacacctaagaaaaaatgttctattgttatagaaatgtctaaatttgaagcctggagtaaacgggcatggacagatgtatttctacagatatacaaggttttggttctatcccgtgtagtgccatactgcagcaataatatgccccccatatgtgtgcaaaatacaccaaaagtcaatccttgttttgcatccagcaacatatattctgattctgaaagaattttgcttagttggatgaacataaattatgagaatactcgacatgtgatatggaaaaactgtcacaaagatgttatcccttctgagagatggatagtaaattttgacaaagacctttcagatggtcttgtttttgcaacacagttgggagcctattgcccattcttgattgagtctcattttataaatatgtacacacgaccaaaaagtcctgaagagtatctgcacaattgcctgattattgtaaatactctttatgaaattgactttgacgtggaaatacaggtgtgtctgagggtgtttccaaaggagatggatgcaggagtcagtggcctgagaaaggaagatatgccctcagtgtgggttgttaccatccgattggctgtggcagtggccagaacaaagagacagaagaagggggatattcagtttgcttgtttttttgtttgtttgttcttttttatttttgtcgtgatctctttctccctttggagcaggatgcatttttttctccttctgcccttggacatctgattccaggtttttcagcctttggactctaggacttgcaccagcagcctcctttgggctttcagccttcggcctcagaatggggcctgcactgtagcttccctggtttgggggatttgggacttggcctgagccatgcttctggcttccctgggagcccctattggcttctgtcattctgcagtttgtagccagcctactgtgggacttcgcctttgtgattgttcagccaattcttcctaataaattcccgtttatatatat

SEQ ID NO: 1519 - DNA, 2204 bp, Homo sapiens
atgcttttaaattatattccagtttgctataaaatattacatcttactggggaagtaaaatcaccagagttattgtttgaccctccatttatatttttcactcctgttcctttggatataacaactgtaatggatatcaacattttacctcaaaactatttcagaaattcaactctatgtgtccagattcccacagtaaggcttcttgatggtgaagagattcaccctctttctgtgaaatttccaaaaggcagagtcatcccaggctctcacagtggaattaataataagctcacttgccacctcagtttcaagtcatctaaacctgtgtcattttttaccaatcttcttttctgtgatgacagaaaaaactggtgttttcacttccagttactgcaacagcagaaaactgcattcttactatttacccatatatggcaattcatctggataagcaaaacattattttaaagaatgataaggatgaatatcttaagaagactagagatggtgttttgcctccctaccaggatgctaaaccaccctctcctgcttcaattaaaaagacatacaccactagcaaattcaatgatgctgaacctgcaaagggaaacttatttattggagtggaagtactgcctgaaaatttgcacttggatgaaagtgaaacatcagaggaagatcatgggtctctggaaaaggaaaaatatgaacaattcctttctcttgaggaaggaacaaaggcacactacttttttgagaaggttgtaaatgcagcacagacctggttcagtctctttggctggcctgaaggaccccattctttttctattccagagactataagaagggatgtatataaaatgcaattctactcatcaacctcgccaccccaaaagttttccagacagaatgacttttccaaatataataagaccatttatgatgtgctgctccatttgagtggaaaaatgccacctggaattaattcaagtcaatctttacctgtagataaccatgaaaaaagggtaattcaactccatttgcaacattcctcacttctggactttctcaatgctcaaggaggatgtatttcacatgtcctgccagaatttttgcttgaaccagaagattataagaggtggattgaaattatgtcttccactaatacgatgcctgtgagttcctgtacacctaagaaaaaatgttctattgttatagaaatgtctaaatttgaagcctggagtaaacgggcatggacagatgtatttctacagatatacaaggttttggttctatcccgtgtagtgccatactgcagcaataatatgccccccatatgtgtgcaaaatacaccaaaagtcaatccttgttttgcatccagcaacatatattctgattctgaaagaattttgcttagttggatgaacataaattatgagaatactcgacatgtgatatggaaaaactgtcacaaagatgttatcccttctgagagatggatagtaaattttgacaaagacctttcagatggtcttgtttttgcaacacagttgggagcctattgcccattcttgattgagtctcattttataaatatgtacacacgaccaaaaagtcctgaagagtatctgcacaattgcctgattattgtaaatactctttatgaaattgactttgacgtggaaatacaggtgtgtctgagggtgtttccaaaggagatggatgcaggagtcagtggcctgagaaaggaagatatgccctcagtgtgggttgttaccatccgattggctgtggcagtggccagaacaaagagacagaagaagggggatattcagtttgcttgtttttttgtttgtttgttcttttttatttttgtcgtgatctctttctccctttggagcaggatgcatttttttctccttctgcccttggacatctgattccaggtttttcagcctttggactctaggacttgcaccagcagcctcctttgggctttcagccttcggcctcagaatggggcctgcactgtagcttccctggtttgggggatttgggacttggcctgagccatgcttctggcttccctgggagcccctattggcttctgtcattctgcagtttgtagccagcctactgtgggacttcgcctttgtgattgttcagccaattcttcctaataaattcccgtttatatatat

SEQ ID NO: 1520 - DNA, 538 bp, Homo sapiens
actgaatgggattctacgaccaaatgaaaagtataatgtttccataagtttctgtccaaatacacagcagatattcctatgcttttaaattatattccagtttgctataaaatattacatcttactggggaagtaaaatcaccagagttattgtttgaccctccatttatatttttcactcctgttcctttggatataacaactgtaatggatatcaacattttacctcaaaactatttcagaaattcaactctatgtgtccagattcccacagtaaggcttcttgatggtgaagagattcaccctctttctgtgaaatttccaaaaggcagagtcatcccaggctctcacagtggaattaataataagctcacttgccacctcagtttcaagtcatctaaacctgtgtcattttttaccaatcttcttttctgtgatgacagaaaaaactggtgttttcacttccagttactgcaacagcagaaaactgcattcttactatttacccatatatggcaattcatctggataagcaaaa

SEQ ID NO: 1521 - DNA, 1281 bp, Homo sapiens
aatcatttgaaccaagttgcggacatgaatcttgttatttgtgtcctacttttgtccatttggaaaaataattgcatgactacaaaccaaaccaatggatcttctactacaggagataaacctgttgaatcaatgcagacaaaattgaactaccttagaagaaatctactcattttagttggtattatcatcatggtttttgtctttatctgtttttgttatctccattataattgtctgagcgatgatgcgtccaaagcaggaatggtcaagaaaaaaggcatagcagccaagtcatctaaaacatcattcagtgaagccaagacagcctctcaatgcagtccagaaacacaacccatgctatctactgcagacaagtcatctgattcatcgagtccagaaagggcatccgcacaatccagcacagaaaaattaatcagaccctcaagtctacaaaagccatccataccaaacagtgcaggaaagttaactaggccatcatatccaaaaaggtcatccaagtcatcatgctcaaaaaaattaagcaagtcatctcacctggaaaaggcacataagaaaggcagcctagaaaaattatgtaagctagactatgcgtgtaagctagccagttcagataagccagtcaggccacctcagctattcaagccactttattcatctcatccacaaaatgaaatctcaccatccaagccattcggtccacaggaattggctaagcctcccaaacattttaatccaaaaaggtcagtgagtctaggcagggcagccttattatccaactctgaattagctgaaacttgtcaaccctacaagaaaaaacatcttgttgccaaaacttataggcctttggtcaatgatatttctgaggcaaaggagaaaaacactcaaaacctacatgtttcaagcaaagtcaagtcctcttccaggtcctttcgtaagttagattccaggaacaatgcatacggtgatcatgtgaatgacagtgatacgatgaaatattatagtgaggttgacagtgataaagttataatcattacgtgtgacagagggtacaatcaagtcacctctgaagtaaccctaaatgattaggagctcaacaaaaataaaatccaagtgtgaaagagcaaacttataccaactattttatgctcatcatcccttaagaaaccagtagagggaaaaatcactatcaagatcacccatatctgtcttggaggcgatttattttaaaaatatcaataaaatgcatgacataaatta

SEQ ID NO: 1522 - DNA, 904 bp, Homo sapiens
aagactgaccagcttcttctgaagacttctgccctctaaagactaaggcctaattccactggtttctttgaattccgtggtcctaagtccattttcagacaaagtttctgtggaaagacctacggacaaagacatctctccttggcagagtgagctaggattaccagctcttcagccgcagctgaaggcgggagtccatggaaccccagaagctgctgataattggatttctgctatgctctctaacttgcctcttgttggagacagtagcttcctctcctttgcctttgtctgccttgggaatacaagaaaaaacaggatcgaaaccacgctcagggggtaatcacaggtcctggctgaacaacttcagggattacttatggcaacttatcaagagtgccttacctccagcagccattgttgcttttcttctcacctcagcactaatggggatcctctgctgcttcaccattcttgtagttgatccagtccactgaagaactagaagattcaacagggcaagtgtggtctctccagttggactccaaaagagtggggcatttgctatctgcttaaaatgaggaagtatctatcagttgaaattaaatcgtcttccaacttgaatcatcctttgccttcattttctccttcaaaagttgcaattttaaaatgtgaatatccttattactgttttggttataatagtaatacatatttattgcaaaaaaaatttgagaaatacagagaaaagagtaagtttccataattctagcaaccagaaataaacatcattaacatcttgatgtacctcccttcaatttttttctatatatgtattacaagttttccaaagtctgttctgtgaaacaatagttctgttttaataaaagtcacaaaacagtga

SEQ ID NO: 1523 - DNA, 6641 bp, Homo sapiens
gcgtgctgactgagctagtcttggggtcctggagaagggggctggaggcatgcccacagcctcccccccatgagcttggggctggcgagggcacaggaggtggagctgacactagagacggttatccagacactggagagcagcgtcctgtgccaggagaaaggcttgggcgcgcgggacctggcccaggacgctcagatcaccagcctgcctgcccttatcagggagattgtcacccgcaacctctcccagcctgagagcccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagaggctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaagattctccagtacaagaagaggtgctcggagctggagcagcagctgctggagagatccggagagctggagcagcagcggctgagggacacagagcacagccaagacctggaaagcgccctcatccggctggaggaggagcagcagaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggagtccttcaacgcctacttcagcaacgagcacagtcgcctgctcctcctctggaggcaggtggtggggttccggcggctggtcagcgaggtgaagatgttcactgagagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccagagtgacagagctgggcctggcagtgaagcgtcttgagaagcagaatctggagaaggatcaggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcgcttggagaaggaagccctggagggcagcctgtttgaggtgcaacggcagctggcccagcttgaggcccgccgggagcagctggaagccgaggggcaggccctgctgctggccaaggagaccctgactggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccggagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggctgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagcccagccccgcggccagtgcccggttcccctgcccgggacgcacccgcagaaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggacgaacttcggacccagaccagtgccctgaatcgccagctggccgagatggaggctgagagggacagcgcaacctcgagggccaggcagctgcagaaggcggtggctgagagtgaggaagcccggcgcagtgtggatgggcggctgagcggggtccaggcggagctggcgctgcaggaggagagtgtgcggcgcagtgagcgggagcgccgggccacgctggaccaggtggccacactggagaggagcctgcaggccaccgagagcgagctccgggccagccaggagaagatcagcaagatgaaggccaatgagacaaagctggagggcgacaagcggcgcctgaaggaggttctggacgcctccgagagccgcactgtcaagctggagctgcagcggcgctcgcttgagggggagctgcagcgcagccgcctgggcctcagtgaccgcgaggcccaagcccaggccctccaggatcgggtggattccctgcagagacaggtggccgacagcgaggtgaaggcagggaccctgcagctgaccgtggagcggctgaatggggccctggctaaggtggaggaaagcgagggggccctgcgggacaaggtgcggggcctgacagaggccctggcccagagcagtgccagcctcaacagcacccgggacaagaacctgcatctgcagaaggctctgaccgcctgtgaacatgaccgccaagtactccaggaacggctggatgccgcccggcaggcattatctgaggcacggaagcagagcagctccctgggcgagcaggtgcagacgttgcgaggcgaggtggctgacctggaactgcagcgggtggaggccgagggccagctacaacagctacgggaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtggagcgggagaagcttcgtagccatgaggacacagtgcggctgagcgcagagaagggccgcctggaccgcaccctcacgggggctgagctggagctggcagaggcgcagaggcagatccagcagctggaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgcgtgggctggaggagcaggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccacccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgtttttaaaaaa

SEQ ID NO: 1524 - DNA, 6096 bp, Homo sapiens
gagaaaggcttgggcgcgcgggacctggcccaggacgctcagatcaccagcctgcctgcccttatcagggagattgtcacccgcaacctctcccagcctgagagcccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggacacagagcacagccaagacctggaaagcgccctcatccggctggaggaggagcagcagaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggagtccttcaacgcctacttcagcaacgagcacagtcgcctgctcctcctctggaggcaggtggtggggttccggcggctggtcagcgaggtgaagatgttcactgagagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccagagtgacagagctgggcctggcagtgaagcgtcttgagaagcagaatctggagaaggatcaggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcgcttggagaaggaagccctggagggcagcctgtttgaggtgcaacggcagctggcccagcttgaggcccgccgggagcagctggaagccgaggggcaggccctgctgctggccaaggagaccctgactggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccggagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggctgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagcccagccccgcggccagtgcccggttcccctgcccgggacgcacccgcagaaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggacgaacttcggacccagaccagtgccctgaatcgccagctggccgagatggaggctgagagggacagcgcaacctcgagggccaggcagctgcagaaggcggtggctgagagtgaggaagcccggcgcagtgtggatgggcggctgagcggggtccaggcggagctggcgctgcaggaggagagtgtgcggcgcagtgagcgggagcgccgggccacgctggaccaggtggccacactggagaggagcctgcaggccaccgagagcgagctccgggccagccaggagaagatcagcaagatgaaggccaatgagacaaagctggagggcgacaagcggcgcctgaaggaggttctggacgcctccgagagccgcactgtcaagctggagctgcagcggcgctcgcttgagggggagctgcagcgcagccgcctgggcctcagtgaccgcgaggcccaagcccaggccctccaggatcgggtggattccctgcagagacaggtggccgacagcgaggtgaaggcagggaccctgcagctgaccgtggagcggctgaatggggccctggctaaggtggaggaaagcgagggggccctgcgggacaaggtgcggggcctgacagaggccctggcccagagcagtgccagcctcaacagcacccgggacaagaacctgcatctgcagaaggctctgaccgcctgtgaacatgaccgccaagtactccaggaacggctggatgccgcccggcaggcattatctgaggcacggaagcagagcagctccctgggcgagcaggtgcagacgttgcgaggcgaggtggctgacctggaactgcagcgggtggaggccgagggccagctacaacagctacgggaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtggagcgggagaagcttcgtagccatgaggacacagtgcggctgagcgcagagaagggccgcctggaccgcaccctcacgggggctgagctggagctggcagaggcgcagaggcagatccagcagctggaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgcgtgggctggaggagcaggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccacccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgcctt

SEQ ID NO: 1525 - DNA, 5091 bp, Homo sapiens
gaggacgagggggagggccggagctgcgcgtgctgctttgcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggagctccagaacatgaagcgcctcttggaccagggtgaagatttacgacatgggctggagacccaggtgatggagctgcagaacaagctgaaacatgtccagggtcctgagcctgctaaggaggtgttactgaaggacctgttagagacccgggaacttctggaagaggtcttggaggggaaacagcgagtagaggagcagctgaggctgcgggagcgggagttgacagccctgaagggggccctgaaagaggaggtagcctcccgtgaccaggaggtggaacatgtccggcagcagtaccagcgagacacagagcagctccgcaggagcatgcaagatgcaacccaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggcagagaaacagcagctggaggaggccctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctggaggactgagccgacttcaggatgagatccagaggctgcggcaggccctgcaggcatcccaggctgagcgggacacagcccggctggacaaagagctactggcccagcgactgcaggggctggagcaagaggcagagaacaagaagcgttcccaggacgacagggcccggcagctgaagggtctcgaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaatcatcagcaataagctgatagatggactttccactgtaggagtggacatttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaa

SEQ ID NO: 1526 - DNA, 1139 bp, Homo sapiens
agggagctccgaggacgagggggagggccggagctgcgcgtgctgctttgcccgagcccgagcccgagcccgagcccgagcccgagcccgagcccgaacgcaagcctgggagcgcggagcccggctagggtgaagttttgcttttgtcacccaagctggagtgcagtggcgcaatctcggctcactgcaacctccacctcccgggttcaagcaattcttctgcttcagcctcctgagtagctgggattacaggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcag

SEQ ID NO: 1527 - DNA, 589 bp, Homo sapiens
cgtcgggggacaacggagatattttctgcagaaagtgacgaaagagcattctggttcctgcagaggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccatt

SEQ ID NO: 1528 - DNA, 564 bp, Homo sapiens
tgggatcagcatccctactttttgagaggctaactctgaggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccatt

SEQ ID NO: 1529 - DNA, 823 bp, Homo sapiens
tggaagagctgaccttggagcagagcattgccgagtatctgaaagatgtcaatgaccctcgctgctgctcggagaccttggggatgacctgcacccactagcatgcctggatggttcaaaaaggcgtggtatgggctggcgtctttactcagcttctcctccttcatcctgatcatcgttgccctggtagtgccccactggctgagtgggaaaatcctttgtcagactggagtggatctggtcaacgccacagacagagagctggtcaagttcattggggacatttactacgggctcttccgagggtgtaaagtgcggcagtgtgggcttgggggccgccaatcccaattcacgatcttcccacacctggtgaaggagctcaacgcaggccttcatgtgatgattctgctgctcctcttcctggccttggccctggctctggtcagcatgggctttgccattcttaacatgatccaggtcccgtaccgggcagtcagcggtcctgggggcatctgcctatggaatgtcctggcaggcggcgtcgtggcgttagccatcgccagcttcgtggctgcggtgaaatttcacgacctgacggaacgaatcgccaactttcaggagaagctcttccagtttgtggtggtggaagaacagtatgaagagtcgttttggatctgcgtggccagcgcttcggcccatgctgcaaacttggtcgtggtggcgatcagtcaaattcccctccctgagattaagaccaaaatcgaagaggccacggtcacagctgaggatatcttgtattaatagccttcccctgttcacaacc

SEQ ID NO: 1530 - DNA, 1152 bp, Homo sapiens
aatgtccattagcataacccttcctcaggaagagtgagattttatatttgacaataaagtgttagactccatttctaaataccagacttcaaaagataaggttcaaaagtgttataagaagatattcctttttttgtcctagagaacttattttcctgtgaaaatgcctaccacaaagaagacattgatgttcttatcaagctttttcaccagccttgggtccttcattgtaatttgctctattcttgggacacaagcatggatcaccagtacaattgctgttagagactctgcttcaaatgggagcattttcatcacttacggactttttcgtggggagagtagtgaagaattgagtcacggacttgcagaaccaaagaaaaagtttgcagttttagagatactgaataattcttcccaaaaaactctgcattcggtgactatcctgttcctggtcctgagtttgatcacgtcgctgctgagctctgggtttaccttctacaacagcatcagcaacccttaccagacattcctggggccgacgggggtgtacacctggaacgggctcggtgcatccttcgtttttgtgaccatgatactgtttgtggcgaacacgcagtccaaccaactctccgaagagttgttccaaatgctttacccggcaaccaccagtaaaggaacgacccacagttacggatactcgttctggctcatactgctcgtcattcttctaaatatagtcactgtaaccatcatcattttctaccagaaggccagataccagcggaagcaggagcagagaaagccaatggaatatgctccaagggacggaattttattctgaattctctttcatctcattttggcgttgcatctattgtacatcagccctgagtagtaactggttagcttctctggacaattcagcatggtaacgtgactgtcatctgtgacagcatttgtgtttcatgacactgtgttcttcattgatgctgtactcctgaaaatttttcccacaaggttggggaaatgaatgggaaatgtcgctggtctgtgtggtattcaaagcagtagtatcatgatgagcgtaacgacccttctgacctggtctcacgatctgaaataataaaaggctgtgtcatgtttcttttc

SEQ ID NO: 1531 - DNA, 949 bp, Homo sapiens
ggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacaggatttgtaaaa

SEQ ID NO: 1532 - DNA, 701 bp, Homo sapiens
gaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtaagtactcttctcagtctgtttccagctcacaggaagtgtatataaattaatattctcaaccaagagacatgaatttcctatatgacttttgaaagtaagacatactgataaatggtaactgatgacatcattcaagattaaatgtgtcatatgccacatacgcaaaatatgcatttaattagtttgctagtgttgcagtgtcttgtctcgaaacagttcaaggcatcaaatttagaactataaacttcatcgtttgctgtacatcatgaaactgaggtcaagtagaggaaacgtgaaaggtgtcagacggagaggaaagaatgatgcggtgtgcgaatagaaaattaaaaccttgccttgattgttgcccactcaaaatgatatttgccagatgctagtttctgggtcttttaaatttgctgtattaactactgtcttaacaagctcctcctaataaacctttataaagaaa

SEQ ID NO: 1533 - DNA, 2549 bp, Homo sapiens
atatccgtgtagaaaatcagaacgactctttcaggccatctttaaaatgtcattggtaaaccatacttgatcctaaattcctgtacttcctcaggccatccgagcatgaaacgctgtcacctacccacatccgctggctgtgacgcttgtcaaagtgttctctatcggctgcatgcctagaccaccaaagcgttctgaccggacagtgtcactggagaaggcggcgcgacatgtccagggcgcagatctgggctctggtgtctggtgtcggagggtttggagctctcgttgctgctaccacgtccaatgagtggaaagtgaccacgcgagcctcctcggtgataacagccacttgggtttaccagggtctgtggatgaactgcgcaggtaacgcgttgggttctttccattgccgaccgcattttactatcttcaaagtagcaggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggatcttgctcattcatggccatatccacatgcccatggccactcagtagattgttgaaaaagcaaagccacaccattctctttgatgtatgcagagagttacgtagcaggggatgttctctgatttattccactggcaccattagtgaatatttagttgttttcataaacgatgctgtgatgaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtg

SEQ ID NO: 1534 - DNA, 3565 bp, Homo sapiens
gccatccagggcattgccgttcagggccacgggaaaacctgactgcgctcccagaagcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagctctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctagtagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggtaatattttaatagtagtcaataatctagcttaaggctgtaactcttctatcggggctaattgtatgaataggtgtcagtatgttgaagattactttcttttgtgactttcttctacctcatgccactgtttaaaagtaaaacgtattttaacgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccgtccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaa

SEQ ID NO: 1535 - DNA, 846 bp, Homo sapiens
ggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagcgtaaatgaagaaaacgaggcacagggaagttctgaatctggcccaaggtcagtgagctatctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatga

SEQ ID NO: 1536 - DNA, 3406 bp, Homo sapiens
ggctcagattattgctactctgtattcagatcttcatgtgtctcttctaagctgaataaagctgttttggaactgtcaggtacctcaaagcgtaatctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctagtagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggtaatattttaatagtagtcaataatctagcttaaggctgtaactcttctatcggggctaattgtatgaataggtgtcagtatgttgaagattactttcttttgtgactttcttctacctcatgccactgtttaaaagtaaaacgtattttaacgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccgtccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaa

SEQ ID NO: 1537 - DNA, 1163 bp, Homo sapiens
caatggtggtttcattcagagtctagtagagaacctcatgcacaaatgaggaaaagtagggtgtatgattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgctcagattattgctactctgtattcagatcttcatgtgtctcttctaagctgaataaagctgttttggaactgtcaggtacctcaaagcaacaaccctgcaaggttggcactgttattttttccatttcacagatgaagaaaacgaggcacagggaagttctgaatctggcccaaggtcagtgagctatctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgta

SEQ ID NO: 1538 - DNA, 1064 bp, Homo sapiens
caatggtggtttcattcagagtctagtagagaacctcatgcacaaatgaggaaaagtagggtgtatgattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgctcagattattgctactctgtattcagatcttcatgtgtctcttctaagctgaataaagctgttttggaactgtcaggtacctcaaagctctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgta

SEQ ID NO: 1539 - DNA, 618 bp, Homo sapiens
gttccgatttctgggtcttttgcataagtaactgaggattttatgtaaaatggctaaatccaggagaatcaggagcgttggaaaacgctgaccacatctgtggatgtgaaaattgagctcagattattgctactctgtattcagatcttcatgtgtctcttctaagctgaataaagctgttttggaactgtcaggtacctcaaagctctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctgg

SEQ ID NO: 1540 - DNA, 1098 bp, Homo sapiens
gcggcccagtggattctgggaattgtagtcccagccatccagggcattgccgttcagggccacgggaaaacctgactgcgctcccagaagcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagcatgaagaaaacgaggcacagggaagttctgaatctggcccaagtctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaa

SEQ ID NO: 1541 - DNA, 3587 bp, Homo sapiens
attgccgttcagggccacgggaaaacctgactgcgctcccagaagcctccggtgtacctcgctgggaacgcacttcctgggacgctgagagggagacgctccaagaggctcctcagtgtgggcgagtaaaatgccctgcgtgtgagaagcaggtaggtgtggtcaagatgttccgatttctgggtcttttgcataagtaactgaggattttatgtaaaatggctaaatccaggagaatcaggagcgttggaaaacgctgaccacatctgcccctagtctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctagtagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggtaatattttaatagtagtcaataatctagcttaaggctgtaactcttctatcggggctaattgtatgaataggtgtcagtatgttgaagattactttcttttgtgactttcttctacctcatgccactgtttaaaagtaaaacgtattttaacgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccgtccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaa

SEQ ID NO: 1542 - DNA, 1370 bp, Homo sapiens
ggctccagggtaagtctgccccccccaccctcgtggggcggggagcccggggcagcccagaggctggggggagggggtggacttttggcccgtttcggttattccctccatctcgtcaacagctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttca

SEQ ID NO: 1543 - DNA, 2131 bp, Homo sapiens
ctgcactggctcgggatggggaccagaggctgctaatccatcatcattaacgaatagagtgggtgacagtccctgataactgggaacaggttgcagagcttagccacaggatcacgctccaggctgttggccagcaggaccaggctcgatgctgagtcaaagatcaacttaggaggaaatttgagttttgggtgagagcgactccctggtggcctcagccctgtgacactcacatccaggacagttcccggtgccaagcgctggttatgtgtggggggcttgactccctggtcccaacgaggtctcagtgtgttgcccaggctggtcttgaactcctgagttcaagcaatcgtctcagcccagcctcccaaagtggtaggattacaggcgagagccactgcgcccggcccctggtcccagttctcaccacagcccctgcagtaagcagtcgggtatgtcactgacagagcagaagctcaggggactaaaactccccgcctgagttccctggtgaatggatggtggggccgagttccattccaggctggatggagcccagagctgtgggtctcctaccctcccatcccctcattccagcttgatcttccttaagagactcatacgccccaaccccttggtctgagtatcttagattgttctcgtggttcctccgtccttcaccactgaaggctgctgttcattctctctccgtctctgtcccttattgctctcacgtctgtctctgtcatcttttcactccttgtccctcttactccgttctttggcccccaatgaaagctgagtcagagacagacgcttcccctcagttcccagtgcctcccttgggggcccctccttggctgtatccgtcagtggctccaggctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttca

SEQ ID NO: 1544 - DNA, 731 bp, Homo sapiens
ccactccgaattgaaccagtcttcaaagtaaaggcaatggcattttatcccttgcaaattgctgggctggttcttgggttccttggcatggtggggactcttgccacaacccttctgcctcagtggagagtatcagcttttgttggcagcaacattattgtctttgagaggctctgggaagggctctggatgaattgcatccgacaagccagggtccggttgcaatgcaagttctatagctccttgttggctctcccgcctgccctggaaacagcccgggccctcatgtgtgtggctgttgctctctccttgatcgccctgcttattggcatctgtggcatgaagcaggtccagtgcacaggctctaacgagagggccaaagcataccttctgggaacttcaggagtcctcttcatcctgacgggcatcttcgttctgattccggtgagctggacagccaatataatcatcagagatttctacaacccagccatccacataggtcagaaacgagagctgggagcagcacttttccttggctgggcaagcgctgctgtcctcttcattggagggggtctgctttgtggattttgctgctgcaacagaaagaagcaagggtacagatatccagtgcctggctaccgtgtgccacacacagataagcgaagaaatacgacaatgcttagtaagacctccaccagttatgtctaatgcctccttttggctccaag

SEQ ID NO: 1545 - DNA, 2959 bp, Homo sapiens
agatggattttgcaaagctgtggttaacgattagaaatcctttatcacctcagcccgtggccccttgtacttcgctcccctccctcaggatccctttctccctctccaggggcatctccccctccaaggctctgcaaagaactgccctgtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgag

SEQ ID NO: 1546 - DNA, 2919 bp, Homo sapiens
aggcatggctgcccttttagcgtgtcccagcctgccaagagggagtgccctggagagacccttgctcaggagcactgccaggggatcagtgccccatttgtacctgcaaggtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattg

SEQ ID NO: 1547 - DNA, 3150 bp, Homo sapiens
cccagagcaagccgattctctacacactgccttcccttcctgtaagactcatcaaaaaggcaccccaaccttgcatggatctgctgttggtattccttggggtgaagccagaagtcaggctttccacagagagacgggactacatggccacctgggaaggctagggagtcaaagggcctgaggaatgactacttccctccacaagggcattccctgccctgctctgcttcctgggggcttcagcaagccttccttctagagctcctagaaccctcccatggtcaacacaacagcagcccagacaatgagatgcaagaggcctgagctcacaggccattcaggtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattg

SEQ ID NO: 1548 - DNA, 1209 bp, Homo sapiens
aaagttcgaagtgggatgatcacgggcagacctgggtggttgggaacaggaagcatatggcatcttgcaggctataggcaccacaaaatggaacgcaggaggacaggggcttgggagagccacttcactgtcgggtaaaacaacggagcaagatgagtgcctccggatgcttggtttccccaccctccagtgtctgcttgctcttcaagtacctccaccaagctaatgacagtccactttaggacatcacgggcctcgaggttacaactttcccaggctttgttatttggttctctactgcacagaaatagatagaattctgacagccatcattgttaaacatcaggattttctaagaggacagacttaacagtaacatcatggcctcagcaggactccagctccttgctttcatcctggccttatctggggtctctggagtgctcacagccactctgctgcccaactggaaggtgaatgtggatgtggactccaacatcataacagccattgtacagctgcacgggctctggatggactgtacgtggtacagcactgggatgttcagctgtgccctgaaacactccattctgtccctccccatccacgtgcaggctgcgagagccaccatggtcctggcgtgtgttctgtctgctttggggatctgcacttccacagtaggaatgaaatgtactcgcttaggaggggacagagaaaccaagagccatgcttcctttgctggaggagtctgtttcatgtctgcaggaatctctagtttaatctcgacagtgtggtacacaaaggagatcatagcaaactttctggatctgacagttccagaaagcaacaaacatgaacctggaggagctatctatatcggattcatttctgcaatgctgttgtttatctctggcatgattttctgcacctcctgtataaaaaggaatccagaagctagactcgacccacccacacagcagcctatctctaacacacagctcgagaacaattccacacacaatctgaaggattatgtgtaaataactgagtaatgcatatgaaatggaacttttgggtgccaaatgggacttttagattaaaaaaaaatcagaattatgcttaactttccctacaaagaaagtagaatgtaaaatactttaacaactacaaagtagtttaaaatgccaataaaactatcatatacaatta

SEQ ID NO: 1549 - DNA, 2708 bp, Homo sapiens
ctgataagattgatttatttggttaagaaatacttttcttaaacctatttttaaaaaataacactcagtattaccataacatgcacatttgaaatgtgagaactataagagatgaaaatctgacaggtgcagttagtgaaacacaaagcaggaggagttgaaccaaaaccatcagttaaacattttgcatttagacttaattctttgttagaaaggttgggaataacatgaaagccattttaaccttgacaatgaaaggagattatcacttaattatatttcagtgacaaactgctttctgtcaaatccagcccacaggacacaaacacaatcttggccacaccttggcattactggttggcggcattatttccctatccttttgtgaaacccattcaacatggaatcaaacaatagcaactctggcaagaatcctcctatatacacaatgaagaaatatttctgagtttcataagttataacacaagtgtcacacttcttttcacagcaaccgaagggcaggagttagtttggctaaagctctcaggacattataatggctttagtatttagaactgtagctcaactagctggagtttcattatctttgctgggatgggttttatcctgtcttacaaactacctgccacactggaagaacctcaacctggacttaaatgaaatggaaaactggaccatgggactctggcaaacctgtgtcatccaagaggaagtggggatgcaatgcaaggactttgactccttcctggctttgcctgctgaactcagggtctccaggatcttaatgtttctgtcaaatgggctgggatttctgggcctgctggtctctgggtttggcctggactgtttgagaattggagagagtcagagagatctcaagaggcgactgctgatcctgggaggaattctgtcctgggcctcgggagtcacagccctggttcccgtctcttgggttgcccacaagacggttcaggagttctgggatgagaacgtcccagactttgtccccaggtgggagtttggggaggccctgtttctgggctggtttgctggactttctcttctgctaggagggtgtctgctccactgtgcagcctgctccagccacgctcccctagcttcgggccactacgcagtggcacaaacacaagatcatcatcaagaactggagacgagaaacaccaacctgaaacactaagccagaaaggacaagcgtctgctgttcaggagacgcttgctcaacactggatttggtaggatgtcccgctctagtcatctcactgtgcttttgatttttgaaaatgcatcttttcctgtggctattaaactatagtttctttccaagactggtaaaccatttttatcttctagtctgagaccaaaatcaatcaagactgaatagtaatgacacccattactgtggatgagttttctcaattttaaaatagcgattgcacagaagtggtaaataaaacattaatctctatgtatctttgaaggtattattcatatggagcggaatcatttggcaaatcatttacttatttcaggtgtttaagataacctagtataataagcctgaggtcttgttgcatatttatttaaaatgcatgacgtcttattatataaaataattactagctctttagaagcttcagaggtgaaaggtgtagacacatcatctccttctgaatcagagacctcagtgtctctatggaacctttttcaaaaggcagccacattcagtcacgccttctatactgtcagaggcaggagggcgatcttgggttttggatgattcaagtagactctgccacacaaacgtgcttctgcatcctgtgttctgtatttcacgggcagcgtttctggcttcccaggcactgagcagcctgtggggggcacggcagggcaggactggggtgtgtgggtagataacctcctgggacggctgcctctctgtggagcacactgccagcccaggcgcagcgaccacagagcacatattctggagcccttcattttatttgctcaatgaaaatacttcgtccttttttatcagcaatacatatagttccaacaagaactattcatcacaaactgccagcctggggatttcttcatgaaatattttgtatttgcttggtacatggttcaaggaaactcttgtgtttgtgccaatcagggaaataaactgaacaataaacgacactgaaatagagtattaggcaatatgtagctttgtttttgcttttttttttaaaaaaaaccactgaatttttttccacccacaaacacatggaaagtgcagaaaccagttaatctatgtgatgtatttgcatacgtttacaaacaagacaaattaaaacagaaacatgttcagaatttaacctgattaaatattaagttcagtcctgagcttttgatatttaagacaatatagataaagcaatagcaaaaaattttaatttatttgatttgcatgctacagagatttagctaaactttgttcatttggctagcaatattctttttgtacctgtaacacttaagattctgatatacaaaattgtaataatatactgataattcaaacttgagaactaaatattacattctttttaccctgtgcgaataaattctaccttttaaaaatagtatttataatattaaaattcatatttgtccat

SEQ ID NO: 1550 - DNA, 2169 bp, Homo sapiens
ggcgtggcccagccgcccggctgcaaggtggggtgtccccgccgctcggatccccatctcacctgccgcgggcgaggtggccccgccgcttcctgcgctcacctcgggtccctccctcccgggccaggtttggccgcggcagccgcccctgggcgcccgcgcccggacccgcggtttcggtcagacccgcccgcgggctggtttcgattagggccagtaggagggcggagcggccgggacgccaggagggaactagcctaagtggggacggtccccgtgcaggagacaaagagcgtccctggagcgatcagggctcaggagcccgacccggagcccggggcgtccgcgctgacttcgggtccccggagcctggggcacggcagggagaagacgacggcggagaaggcgacagcggagaaggaaggcaggctgcaggggcgccgtcggcgcggcgggccgggatgcggacgccggtggtgatgacgctgggcatggtgttggcgccctgcgggctcctgctcaacctgaccggcaccctggcgcccggctggcggctggtgaagggcttcctgaaccagccagtggacgtggagttgtaccagggcctgtgggacatgtgtcgcgagcagagcagccgcgagcgcgagtgcggccagacggaccagtggggctacttcgaggcccagcccgtgctggtggcgcgggcactcatggtcacctcgctggccgccacggtcctggggcttctgctggcgtcgctgggcgtgcgctgctggcaggacgagcccaacttcgtgctggcagggctctcgggcgtcgtgctcttcgtcgctggcctcctcggcctcatcccggtgtcctggtacaaccacttcttgggggaccgcgacgtgctgcccgccccggccagcccggtcacggtgcaggtcagctacagcctggtcctgggctacctgggcagctgcctcctgctgctgggcggcttctcgctggcgctcagcttcgcgccctggtgcgacgagcgttgtcgccgccgccgcaagggaccctccgccgggcctcgccgcagcagcgtcagcaccatccaagtggagtggcccgagcccgacctggcgcccgccatcaagtactacagcgacggccagcaccgaccgccgcctgcccagcaccgcaagcccaagcccaagcccaaggtcggcttccccatgccgcggccgcggcccaaggcctacaccaactcggtggacgtcctcgacggggaggggtgggagtcccaggacgctccctcgtgcagcacccacccctgcgacagctcgctgccctgcgactccgacctctagacgcttgtagagcctggggggcgccgggtggcaaaggactcacccccgcacaggcccgcctggcttcgagttggaacccggacacttgcccctcactggtgtggatggaaatctgcctttcgtgggaccaaacaggactccttggacgattagttcaggttgggtttggttttcttcttaaagagtttagttttcctctccagagggatcagggtcctcttagggagtgacgggcttttcatatatttttgctgaagaatatatggaaagggtggcatttgcgtcacgtggaccagggacagtgctgaaatcagcagtgctcagaaacaatttaacatgttgaaacgacaatattctaaaatactgatgaatcttgcatcaatataattattgggttttttttctttttcctgctgtataactccttgccatgcaaactctcaagaggccaatatattcctggccatgtttgaatgagcctcttaaaataaacttagagccatgcaaatgccagcagcttaatggatttcatggaatgaaataccgtgattaactcatagctacatatcattgcataaatgggatttatcttttttctcacttatttttgcggtgaaagtcgagggcatgcaagagtttctcttccagaagccaagaggagaacaaaggtcctaatgctgtactattccaccctttggacgcctcatccaggacgcagaggactctaggtttaacattttgtacaaaatggaacctgttaatcatattaaagcacatatgtatatatcttttatttataaataaaattttaaaacaatagtttcagtat

SEQ ID NO: 1551 - DNA, 754 bp, Homo sapiens
ctgacccactcgtgctccttttctttctgcatctgtggtgggagtgactatggcctggagtttccgtgcaaaagtccagctcggggggctacttctctccctccttggctgggtctgctcctgtgttaccaccatcctgccccagtggaagactcttaatctggaactgaacgagatggagacctggatcatggggatttgggaggtctgcgtggatcgagaggaagtcgccactgtgtgcaaggcctttgaatccttcttgtctctgccccaggagctccaggtagcccgcatcctcatggtagcctcccatgggctgggcctattggggcttttgctctgcagctttgggtctgaatgcttccagtttcacaggatcagatgggtattcaagaggcggcttggtctcctgggaaggactttggaggcatccgcttcagccactaccctccttccagtctcctgggtggcccatgccacaatccaagacttctgggatgacagcatccctgacatcatacctcggtgggagtttggaggtgccctctacttgggctgggctgctggtattttcctggctcttggtgggctactcctcatcttctcggcctgcctgggaaaagaagatgtgccttttcctttgatggctggtcccacagtccccctatcctgtgctccagtggaggagtcagatggctccttccacctcatgctaagacctaggaacctggtcatctaggactggcttctgcca

SEQ ID NO: 1552 - DNA, 1369 bp, Homo sapiens
cgacactcggcctaggaatttcccttatctccttcgcagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccatcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgc

SEQ ID NO: 1553 - DNA, 1739 bp, Homo sapiens
cgaacggccggacgcggtggctcacgcctttaatcccatcagtttgggagtctgaggcaggcggattacgagagtaggaaacgaaggctcgggaaggttaggtgagttccccatgtcaccgcgctgcttaagtggtgaagcggagtctcaagctctgttctaccctaagcctggcgccctcaccctgggtgagtctggacgtctgccagcccgaggcgggcccagcgaccccagcctccagcgcccccctctgacaagcctgggattcgcacgcccgctgccgtcagggacagggtctctgcccctcctccggggcggtggtccagtgacgtcaccgcttctttaagacccccgcctccgcccctgtcccgacactcggcctaggaatttcccttatctccttcgcagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccatcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgca

SEQ ID NO: 1554 - DNA, 1441 bp, Homo sapiens
tccagttaggagccttgatgccggaggggacagtgggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccctaccaacattaagtatgagtttggccctgccatctttattggctgggcagggtctgccctagtcatcctgggaggtgcactgctctcctgttcctgtcctgggaatgagagcaaggctgggtaccgtgtaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagcaggcttttttcccttcagggcctctgctttcctcccgtccagatccttgcagggagcttggaaccttagtgcacctacttcagttcagaacacttagcaccccactgactccactgacaattgactaaaagatgcaggtgctcgtatctcgacattcattcccacccccctcttatttaaatagctaccaaagtacttcttttttaataaaaaaataaagatttttattaggt

SEQ ID NO: 1555 - DNA, 2008 bp, Homo sapiens
ggaaaaaaaaggagagcagcgggtgggggcgaaagcagggccgaggagagagcactttggacagaacccggcggggaaagggcggcgccgaggcttgtcaggggcgccccgcagcgtcccaggcgcacctgttgggaagaaaggaaggggcttcccggtgttcgagggaaatccagtccggaggggctgactcggagcttgggactcctggggagccaccgcctcctccccagcggcggtcaaaaccgggcaagcgaaggggcgtgaccctggtgctcaggtttcttcctcctcacctgggcaaggaggggtgggggccacgacttccggttcaggtgagtgtcccttcggtgacgtcaggtcatcctcggccgcccctccggtcccgcctccccctcccgcgctcccggggcgcgcgggccgcgcccccgacgccctacatatactcaggtgcgccccacctgtccgcccgcacctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccctaccaacattaagtatgagtttggccctgccatctttattggctgggcagggtctgccctagtcatcctgggaggtgcactgctctcctgttcctgtcctgggaatgagagcaaggctgggtaccgtgtaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagcaggcttttttcccttcagggcctctgctttcctcccgtccagatccttgcagggagcttggaaccttagtgcacctacttcagttcagaacacttagcaccccactgactccactgacaattgactaaaagatgcaggtgctcgtatctcgacattcattcccacccccctcttatttaaatagctaccaaagtacttcttttttaataaaaaaataaagatttttattaggt

SEQ ID NO: 1556 - DNA, 1923 bp, Homo sapiens
ggaaaaaaaaggagagcagcgggtgggggcgaaagcagggccgaggagagagcactttggacagaacccggcggggaaagggcggcgccgaggcttgtcaggggcgccccgcagcgtcccaggcgcacctgttgggaagaaaggaaggggcttcccggtgttcgagggaaatccagtccggaggggctgactcggagcttgggactcctggggagccaccgcctcctccccagcggcggtcaaaaccgggcaagcgaaggggcgtgaccctggtgctcaggtttcttcctcctcacctgggcaaggaggggtgggggccacgacttccggttcaggtgagtgtcccttcggtgacgtcaggtcatcctcggccgcccctccggtcccgcctccccctcccgcgctcccggggcgcgcgggccgcgcccccgacgccctacatatactcaggtgcgccccacctgtccgcccgcacctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtatgagtttggccctgccatctttattggctgggcagggtctgccctagtcatcctgggaggtgcactgctctcctgttcctgtcctgggaatgagagcaaggctgggtaccgtgtaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagcaggcttttttcccttcagggcctctgctttcctcccgtccagatccttgcagggagcttggaaccttagtgcacctacttcagttcagaacacttagcaccccactgactccactgacaattgactaaaagatgcaggtgctcgtatctcgacattcattcccacccccctcttatttaaatagctaccaaagtacttcttttttaataaaaaaataaagatttttattaggt

SEQ ID NO: 1557 - DNA, 1804 bp, Homo sapiens
gttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaattatttg

SEQ ID NO: 1558 - DNA, 2068 bp, Homo sapiens
agcaaagcagctcttatttgaaaaaccactgggttccgagttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaacccaatgctttgattgttctagaaagtatagtaatttgttttctaaggtggttcaagcatctactctttttatcatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaattatttga

SEQ ID NO: 1559 - DNA, 1888 bp, Homo sapiens
agcaaagcagctcttatttgaaaaaccactgggttccgagttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcacgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaacccaatgctttgattgttctagaaagtatagtaatttgttttctaaggtggttcaagcatctactctttttatcatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatt

SEQ ID NO: 1560 - DNA, 2050 bp, Homo sapiens
cagattccagagagtcccaggcgggcgggagtgtgcgatactcggggagctggggcatgtttgcatcacgaaactcggctgggggagagcagaggcagctggggaggggctgcggaaggaggaggctcaggaaggcaagccgacgccccctgtgtgtgtttctgtcctgagcctgttacttttttgacccccgatccgtctcttcttcctcagcttgtcctccatcttcccctcctttacccttggttcccacatgcacagatgctacggacgcttttcctcccctgtccccactcagccgcagcatcccccgctggcccccaggcccctcatccatccgctgcccacgaacccccagccccgcaccctccccgtggctcaggtctcccctatcccggcctccctgcacttcactctgctcctcccctgcctgggccttaaaaccccgcctgcagccgagagcccgcagagtccccaggtggcactgtcagagtcgctcagtgggaacctgcgccagccggcaggagacgtggctgtcctcagcctggcagtgcgtctggagggcctgtgcgagctcagcccaggtgtgacagcggggtggtaagagcagcagcaccctcagggcatccgatgggcggaggcccctcgaggtgacacccaccactcagccgagcgggactacgagtctgctttgtgctccgcgaggaccagaaacacctgcaagaggcacggagaggaggcgcctttcaagaggcgcctttcatggaactgaggactggcctggcttggggacaccaacaagccttccccctcctgctggacacagagacacccacccagcacaccagacacaccctctgagtcacctaggccgcctggggctgagaagacctaaccgaggggccagatggcttcgaccggcttagaactgctgggcatgaccctggctgtgctgggctggctggggaccctggtgtcctgcgccctgcccctgtggaaggtgaccgccttcatcggcaacagcatcgtggtggcccaggtggtgtgggagggcctgtggatgtcctgcgtggtgcagagcacgggccagatgcagtgcaaggtgtacgactcactgctggctctgccgcaggacctgcaggccgcacgtgccctctgtgtcattgccctcctgctggccctgcttggcctcctggtggccatcacaggtgcccagtgtaccacgtgtgtggaggacgaaggtgccaaggcccgtatcgtgctcaccgcgggggtcatcctcctcctcgccggcatcctggtgctcatccctgtgtgctggacggcgcacgccatcatccaggacttctacaaccccctggtggctgaggccctcaagcgggagctgggggcctccctctacctgggctgggcggcggctgcactgcttatgctgggcggggggctcctctgctgcacgtgccccccgccccaggtcgagcggccccgcggacctcggctgggctactccatcccctcccgctcgggtgcatctggactggacaagagggactacgtgtgaggcggaggtttcccctgggagcccactgctccccactgccccgccctttcgaccttggcctgatgaccagatgccctgctccatcacaacctccttccccaggaaaacccactttccaaaagcccaagctacacctggctgcagggctgggtcagctggcctggctgagctcttctcagtggggtcccctttgatgttctcccccaagttgggcagcctagaggtgttgggaaccctggcctgcccccacctccccagtaattgtttccttccgttgcccaggacactggctggccttccttctcttctgagccctcccctgccccaggaaccctggcctcaccaaaacagcagcagctcgttggctccaaaaccagggagcagaccatgccctcccaaccctggagttgtcagggagggcctgcccatcacctccctctccccaacatccccaccctcgagttggaaataaagagcatttgtaactgg

SEQ ID NO: 1561 - DNA, 2161 bp, Homo sapiens
agtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgta

SEQ ID NO: 1562 - DNA, 2228 bp, Homo sapiens
tatcgccgcctcagacagctttcagtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactc

SEQ ID NO: 1563 - DNA, 2170 bp, Homo sapiens
aaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagaga

SEQ ID NO: 1564 - DNA, 2159 bp, Homo sapiens
ggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgtgttgtctgttttagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagaga

SEQ ID NO: 1565 - DNA, 2227 bp, Homo sapiens
tatcgccgcctcagacagctttcagtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgt

SEQ ID NO: 1566 - DNA, 865 bp, Homo sapiens
aagtgcgtcagaggaggcgcggggagagtagggtgctgtggtctgagctagagggtgaagctggcggagcaggaggatgggcgtatgcaggtgatagactagagaacaagacctctgtctccgtagcatcctggtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacacca

SEQ ID NO: 1567 - DNA, 2818 bp, Homo sapiens
gggatttttaaaaaatcaaaatacaaatccaactttttgagttttcgttgtcattgctcttatctttcctgagtcacttcccattttccaaactcagcaaccccagtttgcgagtctgttttcatgaacctttgtaaggtgtttggtgcggtcacggtgtatacttgccgtgtagtatttgactcagcgcgatctgccttgagtcattttaccgcggccatttactactgccgttgagccctgtccacgccttgggagtgttgatatgttgagagttttctgtctggctgaggagggatcatttagtttttgcggacgtatgttgcactgaggatttagggagagagcaagatttctgttgaggaggttcagaagtataaggaatcgggagagtagataggagtgaagcatttggcagcgtaaagaagcttggcttagctttaatggattagggagagattgctatctagcattattacatgttattgttctctttgctattttatacacctagaacaacctttccctcggggttaacaaacatcttcaactctgttttctgtatggctcctgactcttacctttgttttaggaggcttccctcttcagaggaaactgggagaagccaatttccactgcttctttttcctgtgcctttttaacactcaaacccagaacacttaatcctctgcagctcgtgcaaaaattcagtctgtaatttaaaatgtgtgcacggtacactgctgaccatgggcatgtctattgtttgtatctgtaatgtgtatgtccatttcagtgttgtctgttttagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagaga

SEQ ID NO: 1568 - DNA, 414 bp, Homo sapiens
gtggctgctgcaggcgtccggcttggacgaaccgccgttcccagtgctgggaccctttaagtgttgtctgttttagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattg

SEQ ID NO: 1569 - DNA, 903 bp, Homo sapiens
gcggtgagtgagcgggacctgcgtcgccgggcaggggtcgcgtcgcggttccatgttcccggcggtttgaagaggggcccccttcccgggcgtggtcgggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccat

SEQ ID NO: 1570 - DNA, 556 bp, Homo sapiens
gagtgagcgggacctgcgtcgccgggcaggggtcgcgtcgcggttccatgttcccggcggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttacctttt

SEQ ID NO: 1571 - DNA, 681 bp, Homo sapiens
atggagggggcgggctctgcagggaagtgcgtcagaggaggcgcggggagagtagggtgctgtggtctgagctagagggtgaagctggcggagcaggaggatgggcggtgatagactagagaacaagacctctgtctccgtagcatcctggtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgcca

SEQ ID NO: 1572 - DNA, 916 bp, Homo sapiens
tctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgc

SEQ ID NO: 1573 - DNA, 2124 bp, Homo sapiens
agttatggagggggcgggctctgcagggaagtgcgtcagaggaggcgcggggagagtagggtgctgtggtctgagctagagggtgaagctggcggagcaggaggatgggcgtgttgtctgttttagtatgcaggtgatagactagagaacaagacctctgtctccgtagcatcctggtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaa

SEQ ID NO: 1574 - DNA, 642 bp, Homo sapiens
agtagggtgctgtggtctgagctagagggtgaagctggcggagcaggaggatgggcgagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatg

SEQ ID NO: 1575 - DNA, 574 bp, Homo sapiens
gagtgagcgggacctgcgtcgccgggcaggggtcgcgtcgcggttccatgttcccggcggtttgaagaggggcccccttcccgggcgtgggccgagcacggctgccccgccccagccctggccttctccggccccgccgtgaggcccaggaggtggctgctgcaggcgtccggcttggacgaaccgccgttcccagtgctgggaccctttaagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacag

SEQ ID NO: 1576 - DNA, 999 bp, Homo sapiens
gggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaagagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaaga

SEQ ID NO: 1577 - DNA, 862 bp, Homo sapiens
gaggtggctgctgcaggcgtccggcttggacgaaccgccgttcccagtgctgggaccctttaagtatgcaggtgatagactagagaacaagacctctgtctccgtagcatcctggtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacac

SEQ ID NO: 1578 - DNA, 1013 bp, Homo sapiens
gagtgagcgggacctgcgtcgccgggcaggggtcgcgtcgcggttccatgttcccggcggtttgaagaggggcccccttcccgggcgtggtcgggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttgga

SEQ ID NO: 1579 - DNA, 663 bp, Homo sapiens
ggaggtggctgctgcaggcgtccggcttggacgaaccgccgttcccagtgctgggaccctttaaggtgatagactagagaacaagacctctgtctccgtagcatcctggtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcag

SEQ ID NO: 1580 - DNA, 974 bp, Homo sapiens
gtctctctgggctctgtgtctaaggagccctagggcactgggtgtgagtcacttaggtgggcctgtgtggaggggtgtctggggaggacattgaacaggctgggctgaaagggcgttcggctgtcgggggaggtctctgggaagacaggttcctcacagcaaagcctgtggtgaaggtctcagaggcctctcaggggaagtctcaaggtctccagtaaggggaacgaggtctggagggaggaggttgtggatcctcaggcagggttgttgagggaggggggtctccaggtccccagaagcagggacctcaggcaggagtaccaggggaggagtgtggaggaagcgggctcctcagctgggggcctcggggtaggaaaggcctgggcccatcctgcccttgtggcccccggctgcagcctcagtggcatgggggtgaagcggagcctccagagtgggggcattctgctcagcctcgtggccaacgtcctcatggtgctctccacggccaccaactactggacccgccaacaagagggccacagtggcctgtggcaggaatgcaaccacggcatctgctccagcatcccctgccagaccacgctggcggtgactgtggcgtgcatggtgctggcggtgggtgtcggcgtggtgggcatggtgatgggactgcggattcggtgcgacgagggcgagtcgctgcggggccagaccacgagcgccttcctcttcctcggcggactgctgctgctgaccgccttgataggctacaccgtgaagaatgcgtggaagaacaacgtcttcttctcttggtcctatttttctgggtggctggccttacccttctcaattctcgcgggcttctgctttctgctggcagacatgatcatgcagagcaccgacgccatcagtggattccccgtgtgtctgtgactgcagcctgcctggggcagaataaaggaacggctttttttagc

SEQ ID NO: 1581 - DNA, 3486 bp, Homo sapiens
ctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaacagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctctttctcaatggatctaatgttttaattttttcccctattggtagagaacaataacagaagtaatttttatattatacacttggagaaataaagttgaaacagaattaaaaatatttctcaaacaactgtatcacaatataaattaaactaattcatttttgtgtagacatacgaaatcacaaaaataataacactgaaataattctaccaatgcagtgatggaaacacttttcttatgtaccaagacatagataggtaagagaaataaagaattgaagtgaattagaaaatccattttattgcttgggtttaaaatagttgtgggatacaagtatttacaatgctattggagtcaattattgacaacactttgcaacagtaataccatttctagcttttcaattggcaatacttagaaccttactgtagtgacctgattttaaataccatattatatttactaagttaagagctagtttttactctcttccataatttcattacatgaatgtaagatgatggctcaaaaatgacgacttatagtttgaatttatgtgtatgcaatatacatatgagaaccaaattcaacaagtgacatgaatgttactacatgaacattgaattgtattgcccttgtcagttatttcctctgttcaataaatactgaaggtcacaaacacctttttacttttcaa

SEQ ID NO: 1582 - DNA, 3622 bp, Homo sapiens
gaatcgggcgcacacgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaaggcagttttcttagctgtgattcccactgctgccattgtctgtgcaatcacatccagaagaagggtcacggttacatggatctgctgggaaaacaattagtggaaaagggggcaaatagagttaatggccgtttttggtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaacagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctctttctcaatggatctaatgttttaattttttcccctattggtagagaacaataacagaagtaatttttatattatacacttggagaaataaagttgaaacagaattaaaaatatttctcaaacaactgtatcacaatataaattaaactaattcatttttgtgtagacatacgaaatcacaaaaataataacactgaaataattctaccaatgcagtgatggaaacacttttcttatgtaccaagacatagataggtaagagaaataaagaattgaagtgaattagaaaatccattttattgcttgggtttaaaatagttgtgggatacaagtatttacaatgctattggagtcaattattgacaacactttgcaacagtaataccatttctagcttttcaattggcaatacttagaaccttactgtagtgacctgattttaaataccatattatatttactaagttaagagctagtttttactctcttccataatttcattacatgaatgtaagatgatggctcaaaaatgacgacttatagtttgaatttatgtgtatgcaatatacatatgagaaccaaattcaacaagtgacatgaatgttactacatgaacattgaattgtattgcccttgtcagttatttcctctgttcaataaatactgaaggtcacaaa

SEQ ID NO: 1583 - DNA, 552 bp, Homo sapiens
gctagttctgctccaagaacccaagaggtaaggccttcagtcaagaggacagcccacgtctcattgttccagtggcctaatcaagggaatggaagatgaggagaatgaaggctctgggaatttattttcatcgtggaccggactttttatcagccaggaaaaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagattt

SEQ ID NO: 1584 - DNA, 3025 bp, Homo sapiens
acaaagggcgaagagaggggcgtggggaggctggaaagcatggttgccccgcctggcccggcgacgcccgctcagcagcctgctgaggagtggggacgaagagcagcctaaacttagggctcgggatatttcgatgccacccaaattgccgtcctaccccaacgaggcagggaaaggagcggagcgcgcgcgcgagctgagtgagtgcttacgtcgcagcgagatctgtgctgggataattagagaggagttgggctgagccgagtcctctttcagcagcagcagccggagccgccgccgcagcccggtggggcaaccctgactcggaccgctcgggagagccccaggagaggccagcgccgcgcagcagccgccccgctgcgcccacctccccggctgctcccggagggctcacaaaggcggtggccgcccgagtggccttctccatccaggcgttcgcgtcctcctccccaccttctctcccgaaggcgaaaatggcagggccaggcgagaacctgggacagcggtggccctagccctgcgatcctcacccctcctgctaggagaggctgcgggctgcccgcggacgatgtggccgcggctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcgaccccgcctctgggtttgctgatgatctctctccgccctggagctcagcgctgaagagctaccttattattaatcagaatttccatcgccacccctggcaggcgtatccttcagcagggaccgcaggaacattcacagtgcaggggctgagatgtgcgtgggggttgtttttgttacatcttggaagagaagagaagaggacagtaccaagatcagaaacacccgtgctaggtggaattaggggtgatttgttaggaaagagaaaggacaagaagaggagtgcggagcccttcaggggttcacatctctttaaaggaaaggaaagagggagccaaagtagggtgttgtattttagggggcagaggaagaagtttacaccccccggcccccccagctttgctgggggaaagcaggagcaacagggcacttgattggacaccaagattattaatttcctgtaggggagaggaagcaggcagcaggaggtctgggggctggagtctggtggtggcaaggaccaggtttgctttgggacagtcaacaaggtcttctgagggaaagctcagagataggcagaacaatgactcatttgcaagccggtctctcccctgagaccctggagaaagctcgcctggagctcaatgaaaacccagacacgctgcaccaggacatccaggaggtgagggatatggtcatcaccaggccggacattggctttctgcgcacggatgatgccttcatcttacgcttcttgcgggctaggaagtttcatcactttgaggccttccgcctcctggcgcagtactttgagtaccggcagcagaacctggacatgttcaaaagctttaaggccaccgaccctggcatcaagcaggcactgaaggatggcttccctgggggcctggccaatctggaccactatggcaggaagattctagtcctttttgctgccaattgggatcagagcaggtacacactggtggatattttgcgtgccatcttactttctttagaagccatgattgaagatcctgagcttcaagtgaatgggtttgttttgatcatagactggagtaacttcactttcaagcaagcctctaaactcacaccaagtatgctgcgattagctattgaaggcctgcaggatagtttcccagcgcgatttggaggaattcattttgtcaatcaaccatggtatatccatgccctgtacaccgtgatccggcctttcctgaaggagaaaactcggaaaaggatatttttgcatggtaacaacctgaacagtctacaccaactaattcatcctgagatcctgccctctgagtttggaggaatgctgcctccttatgacatggggacatgggcaagaacactgctagaccatgaatatgacgatgacagcgagtacaatgtagactcctacagcatgcctgtgaaggaagtagagaaggaactctccccaaagtccatgaagagatctcaatcagtagtggatcctacagtactaaaacgcatggataaaaatgaggaagaaaacatgcaaccattgctttctctggactaataacttctctacatccccttcatggattagaaatggaaagtattggttttcagcaacagggacaacactgtagaggaattaccagctggaaaccgacttattcatgttaatgtagcataatatataacaaggcatcaggctttccttggcctgaaccatgggggccctgggctggatttttaaaatgtcaataatttattctgtaagtgccaagttgtttgtaaatataatgtaatcttcatgtcaagtttgtaaatttcagtagtaactcagtttggaaaaaggttggctcaaaagtccatgccagtgttatgaactataacaaaaagcagaaaagacacagtcaaagctaattaaatgtagccctctttcctatgaagccatatttcagctctcatagtgattgtttcattgtttttctctgaaactctgtcagtattcaaacatactcttaacgggcacacacaactaagtgattccaggaaattttatgattaatgtatttcctgtctagtgattttcatttcagagaaatgtgtcttagtaactatcattggccttgcattttggaggcaaggaatggcagatgagctggtaaactgaacacttgaactcttctatgttgtttaattcttggaatcttgtgaaaagatgtgtttcctcaattaagacgtagaaatgtaaaaaagagtggattctttttaaa

SEQ ID NO: 1585 - DNA, 1359 bp, Homo sapiens
ggctgatggatgccagggagtgccgcattgcttagcgaccccgcctctgggtttgctggtacacactggtggatattttgcgtgccatcttactttctttagaagccatgattgaagatcctgagcttcaagtgaatgggtttgttttgatcatagactggagtaacttcactttcaagcaagcctctaaactcacaccaagtatgctgcgattagctattgaaggcctgcaggatagtttcccagcgcgatttggaggaattcattttgtcaatcaaccatggtatatccatgccctgtacaccgtgatccggcctttcctgaaggagaaaactcggaaaaggatatttttgcatggtaacaacctgaacagtctacaccaactaattcatcctgagatcctgccctctgagtttggaggaatgctgcctccttatgacatggggacatgggcaagaacactgctagaccatgaatatgacgatgacagcgagtacaatgtagactcctacagcatgcctgtgaaggaagtagagaaggaactctccccaaagtccatgaagagatctcaatcagtagtggatcctacagtactaaaacgcatggataaaaatgaggaagaaaacatgcaaccattgctttctctggactaataacttctctacatccccttcatggattagaaatggaaagtattggttttcagcaacagggacaacactgtagaggaattaccagctggaaaccgacttattcatgttaatgtagcataatatataacaaggcatcaggctttccttggcctgaaccatgggggccctgggctggatttttaaaatgtcaataatttattctgtaagtgccaagttgtttgtaaatataatgtaatcttcatgtcaagtttgtaaatttcagtagtaactcagtttggaaaaaggttggctcaaaagtccatgccagtgttatgaactataacaaaaagcagaaaagacacagtcaaagctaattaaatgtagccctctttcctatgaagccatatttcagctctcatagtgattgtttcattgtttttctctgaaactctgtcagtattcaaacatactcttaacgggcacacacaactaagtgattccaggaaattttatgattaatgtatttcctgtctagtgattttcatttcagagaaatgtgtcttagtaactatcattggccttgcattttggaggcaaggaatggcagatgagctggtaaactgaacacttgaactcttctatgttgtttaattcttggaatcttgtgaaaagatgtgtttcctcaattaagacgtagaaatgtaaaaaagagtggattctttttaaa

SEQ ID NO: 1586 - DNA, 2469 bp, Homo sapiens
gacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagctccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactc

SEQ ID NO: 1587 - DNA, 2066 bp, Homo sapiens
ggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagctccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccagggtttgtttgtggaggcgctgtctgtccctctgtccctctgtgtttccagccatctcgccctgccagcccagcaccactgggaatcatggtga

SEQ ID NO: 1588 - DNA, 2313 bp, Homo sapiens
atggaacgaaaaggacgcgaagaatcggcagggagaagcggacaggatgtcccgaaaggctcatataaccgaaaaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagctccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgg

SEQ ID NO: 1589 - DNA, 2342 bp, Homo sapiens
aaactaagggtctctcagcagatggccgggtttagagctgtacgaagacacacagctaatgaaaaattgtggaattctcagagcccgtgaagcctagcccacggatgcgaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagctccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggtt

SEQ ID NO: 1590 - DNA, 3240 bp, Homo sapiens
cgtagtttatttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaa

SEQ ID NO: 1591 - DNA, 2203 bp, Homo sapiens
tgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcagccccaagagactgcaaagaatgatgctcagtcaagaagctgggcagggctgaatgctggagtctcactgaagaacaccaagatttcctcctctgaatggcccctcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggc

SEQ ID NO: 1592 - DNA, 3078 bp, Homo sapiens
tctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattc

SEQ ID NO: 1593 - DNA, 2133 bp, Homo sapiens
atttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtgg

SEQ ID NO: 1594 - DNA, 4695 bp, Homo sapiens
actctggtgaatagacggctgtggggcagagaagcgtgaaggcctggctgccgggcaggtgaactctccacggggtctagggcccgcgaaagggttcggaaccgagtcagcgcgccttgcgggcaggattcacgccgctgtgacccggaggtcctcagggggcgaagccccggcctaggcctcgcggagatgcccagctgcggtgcttgtacttgcggcgcggcggccgtccggctcatcacctcctcactcgcctccgcgcagagaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaaccaccacctccccctaagaagatttataactacctcgacaagtatgttgttggccagtcatttgctaagaaggtgctttcagttgctgtgtacaatcattataagagaatatataataatatcccagctaatctgagacagcaagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaaggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgagccacgaaatgctgttattcctcagtaccaggccttattcagcatggataagtgtgaactgaatgttactgaggatgctttgaaagctatagccagattggcactagaacgaaaaacaggtgcacgaggccttcggtccataatggaaaagctgttactagaaccaatgtttgaagtccctaattctgatatcgtatgtgtggaggttgacaaagaagtagtagaaggaaaaaaggaaccaggatacatccgggctccaacaaaagaatcctctgaagaggagtatgactctggagttgaagaagaaggatggccccgccaagcagatgctgcaaacagctaaactgtcatattgctgtcttgtatatacagcttttccttcttttgtttaggatcataattgtctctacagtctgatattaaaggcattggatctatcttggatatcatacatggtcagagaagcctttaggagaagaatcagatcatgtatataattgtaacatcacattgattttacggaagatgttatatggactttaatgacacaatgtttagagataaaatgtacattattttggttcagttttttaaaaaaaatatgctttaacaaaattcttaggaattcttttaagcaatgcaggtattgcgataactgtagattttacaataatgttactctacaaatgggaaaataaattctttaaaattgaatattgagataccattctttagtgttaccttttttacccacatgtgtttctgaaaatattggaattttattcatcttaaaaattggaccaggtaggccgggcgtggtggctcacgcctgtaatcccagcactttgggaggccaaggcgggtggatcacgaggtcaggagttcaagaccagcctggccaagatggtgaaaccccatctctactaaaaatatgaaaaattagctgggtgccgtggcaggtgcctgtaatcccagctactcgggaggctgaggcaggagaatcgcttgaactcggagggcagagtttacagtgagctgaggttgtgccactgcactccagcctgggcgacaaagtgagactccgtctcagggcgaaaacaaaaaattggaccaggtagttttcaagtagttaaacatttcattgaaaaataccctgaagaactatattttgataattggtttagctgtattcctagtcttatctgctaatgcatgacactaacttcccaattggttctgtaaaaaaggccattttcttaccaagttgtctgatttatttaccatcttttttttttttttttttttaattgagcggagtctcacgctgtcccaagctgaagtgcagtggtgcgatcttggctcactgcaacctccgcctcccaggttcaagcaattttcctgcctcagccttccaagtagctgggattataggcacgcaccaccacacctggctaatttttgtatttttagtagagacagggtttcaccctgttggccaggctagtctgtaactcctgaccttgtgatctgctggcctcagcctcccaaagtgctgggattgcaggcgtaagccaccacacccggccttatttaccatctttaatccattttagtactatgggtgagtacatggaattgaagtctggcttaaatcttcagaaagttatatatctattttattttatttttttgagacagagtctcgctgtgtcacccaggctggagtacagtgccacaatcttggctcactgcaacctctgagtcccaggttcaagcgatactcatgcctcagcctcctgagtagctgggactacaggcgtgcaccaccacacctggctaattttttgtatttttagtagagacggggtttcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatggtggtacaagttctatattcattcagtttaatctcatttgaaattgtttaaatcagagtacatgtaaatatttgtgggtttttttttttggtttatagactcgagctttccttttacacagttttttttagggaaaaactaaagctattaggaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagttgttaacaaagcatagtcgatgtttttaaatcaaacataatttgtatcttggaacttacattttgacatttgaataaaacaaaaagactaaatgaaa

SEQ ID NO: 1595 - DNA, 3105 bp, Homo sapiens
gtggggcagagaagcgtgaaggcctggctgccgggcaggtgaactctccacggggtctagggcccgcgaaagggttcggaaccgagtcagcgcgccttgcgggcaggattcacgccgctgtgacccggaggtcctcagggggcgaagccccggcctaggcctcgcggagatgcccagctgcggtgcttgtacttgcggcgcggcggccgtccggctcatcacctcctcactcgcctccgcgcagagaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaaccaccacctccccctaagaagatttataactacctcgacaagtatgttgttggccagtcatttgctaagaaggtgctttcagttgctgtgtacaatcattataagagaatatataataatatcccagctaatctgagacagcaagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaaggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgagccaccacacccggccttatttaccatctttaatccattttagtactatgggtgagtacatggaattgaagtctggcttaaatcttcagaaagttatatatctattttattttatttttttgagacagagtctcgctgtgtcacccaggctggagtacagtgccacaatcttggctcactgcaacctctgagtcccaggttcaagcgatactcatgcctcagcctcctgagtagctgggactacaggcgtgcaccaccacacctggctaattttttgtatttttagtagagacggggtttcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatggtggtacaagttctatattcattcagtttaatctcatttgaaattgtttaaatcagagtacatgtaaatatttgtgggtttttttttttggtttatagactcgagctttccttttacacagttttttttagggaaaaactaaagctattaggaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagttgttaacaaagcatagtcgatgtttttaaatcaaacataatttgtatcttggaacttacattttgacatttgaataaaacaaaaagactaaatgaaa

SEQ ID NO: 1596 - DNA, 3076 bp, Homo sapiens
agtcggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgactttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattg

SEQ ID NO: 1597 - DNA, 1897 bp, Homo sapiens
ttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaactg

SEQ ID NO: 1598 - DNA, 1026 bp, Homo sapiens
acgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacactgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaaga

SEQ ID NO: 1599 - DNA, 880 bp, Homo sapiens
acgtcggcaccagctgcggggcaagatggaggcgctgattttgtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctgg

SEQ ID NO: 1600 - DNA, 537 bp, Homo sapiens
cttttcagcccaggagtccagccaggtctgcgtttctcccatgcatttgacgaattccaacctgatggtccactcgaatgtgacctttaaactttatacaggttgtcgtcgccttgtgtccccacggctctcctagggacagggaaactgagtcatatcaaggtggaaggcagctgaaggcggggcctaatgggaacgtatggccaatcagcggcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctg

SEQ ID NO: 1601 - DNA, 1652 bp, Homo sapiens
ccttccttcctctcccaggcccgagccatggcaacagcgtgacgtgggggtaccgagatctgcgggagcagcggtcccggcttcagttctagcctacccggcagcctggacgggagcaaggcgagaggtgctgccgcctcccgtcgcccctgcgctcagaggtcccgaaccagcccagccgctgcctcttgccgctccgcctttggagtgaggagggcgcagcccgcgtcagaacttagagggccaggcagggtcgcgcgcatggcctgggcgggctcgcggcgggtcccagctgggacgcgcgcggcagccgagcgctgctgccggctctcgctcagcccgggcgcgcaaccggccccgcccccaggccctctgccaccgccgcgaccaatgaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtg

SEQ ID NO: 1602 - DNA, 1410 bp, Homo sapiens
gggggtcgctgcgaaccccggggttccgcggtggaggggtgctatactgggatgcaggcgcggcggggactggcagcaatcatgccctgggagctaacgtagagctttggataatgcttttgcaagttgtacgagaagggaagttctcggggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaa

SEQ ID NO: 1603 - DNA, 1369 bp, Homo sapiens
aaagcttgtttggacgaccttcgtctgggatgcactcttcttctccttcacctacaaatgatagaggattacgaagaactatacggttggctcctctttcctttggccttaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtg

SEQ ID NO: 1604 - DNA, 410 bp, Homo sapiens
ctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaagg

SEQ ID NO: 1605 - DNA, 2239 bp, Homo sapiens
aagaaggggcgtgtcaggctgcgcaggcggccagtccattggctggaagagaccggagccgggctccgggcccgaccagaggagggcggtgctgcagggctggtccgggaggtgacgaccggcttcggagagtctatcatggcagctcggactggtcatacggccttgagaagggtagtctcgggatgccgtccgaagtcggcgacagcggccggggcgcaggcgcccgtgcggaatggcagatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttctttttttttttttttttggtgagtggtccagagctttaagctacttttccagtagtttgccactttctccgaggtagtttggctgctctttcagtaatgctaattgtgtgtcaaattttgtctacaacagtaggcaacagatgaagataagttggttgaatgtctccagcactatgcatccctattttctatttattgtgtacactcactttcagtaatgtgtttcaaactggtattttttaaaaaacaaatcaatgtaaggactgaagttgaagtagcaatgtaataaagttaatttgtttattttttgtacagttagtttggttattgaaatcttcctatattgtttaaatgtgtatttgcatagacatagtaaagtgttacagcatttcatgtcttaaaaatatctatgaagatatctaaaatatctatttctatgaagaaacagactttaacaaatataagcaaaattcagttttcttttaaccagt

SEQ ID NO: 1606 - DNA, 1355 bp, Homo sapiens
ttttttttgcgtttggcatctgagggactcaagagcggcgcgcatcaccttgggcccaaggctgtgttcgtggctcgtttgcctcgtgagaggcggtgaatcatcggcgaagcgactttggaagcaatttggccattggtgcctttgggctcttccggtctcctcccctatggcttgttgctactgctgttggaaagttttaactttgcgcagaagggttgccggctgctggctgtatgggagtttgtgtttggcgatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctggg

SEQ ID NO: 1607 - DNA, 1580 bp, Homo sapiens
gtgcatttccgtgtctttagaggagaaggcttttttttgcgtttggcatctgagggactcaagagcggcgcgcatcaccttgggcccaaggctgtgttcgtggctcgtttgcctcgtgagaggcggtgaatcatcggcgaagcgactttggaagcaatttggccattggtgcctttgggctcttccggtctcctcccctatggcttgttgctactgctgttggaaagttttaactttgcgcagaagggttgccggctgctggctgtatgggagtttgtgtttggcggtgagcccccttctccggttccttctacctgccagatggtcagatgcgttttcccaatttctgaaagagtgctttgccctcgccatttagtgtttacaaaactaaatacagccagcataagggacttggattttttcactctgctgtaacttacaggtcctgtaaccttgaagcatagtcagctttcgattttcctgatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctg

SEQ ID NO: 1608 - DNA, 1535 bp, Homo sapiens
aacaaggcgtactctctggccgttgtcactcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatatttacaccattgcctttgggatccggaatgtcacacacattgatcaggcactccaggaagctcatcgggtgctgaaaccaggaggacggtttctctgtctggaatttagccaagtgaacaatcccctcatatccaggctttatgatctatatagcttccaggtcatccctgtcctgggagaggtcatcgctggagactggaagtcctatcagtaccttgtagagagtatccgaaggtttccgtctcaggaagagttcaaggacatgatagaagatgcaggctttcacaaggtgacttacgaaagtctaacatcaggcattgtggccattcattctggcttcaaactttaattcctttcctatcatggagcatgaaccagtcatatcctgttgaaagcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctcccagaggcatttggtctgtatctttgctcaactgctaatttctcttggctgtagggtgtgtggttaaggtacaaccacccctaaagctcagttttgaagtgagtgtatttatagcttctctgctggtgctgccttctagagggatgatagatcatttgaacccaatgacaatttttaaccagaaaatttaattgtacctgaatcaacctttcagcctaggacgaagtctaggcccaagtcagagtattaatgatcatgagaattgtgtgctgaaccagtaaacgagtttaccttttgatggta

SEQ ID NO: 1609 - DNA, 750 bp, Homo sapiens
actaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacatcaacaaggagatgctaaaggttggaaagcagaaagccttggctcaaggacatgatagaagatgcaggctttcacaaggtgacttacgaaagtctaacatcaggcattgtggccattcattctggcttcaaactttaattcctttcctatcatggagcatgaaccagtcatatcctgttgaaagcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctcccagaggcatttggtctgtatctttgctcaactgctaa

SEQ ID NO: 1610 - DNA, 1535 bp, Homo sapiens
ctttcccgggggcagtctcttttctctcctcacctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacatt

SEQ ID NO: 1611 - DNA, 2118 bp, Homo sapiens
gcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatt

SEQ ID NO: 1612 - DNA, 1608 bp, Homo sapiens
cctctccgggattcctttcccgggggcagtctcttttctctcctcacctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacatt

SEQ ID NO: 1613 - DNA, 1135 bp, Homo sapiens
gtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaagcaatattgtttctgattggagtgatgtttccctcttggttttaatgcagactttccttttgtgtttccaggtgtgggacgcctgctcagaggccctgataatgtttgataaggataatttagatgacatgggctatatcgtggagaatgatgtcatcatgcatgctctcactaagcagttggaggctgtgtctggtgaggcccccatcttccaccttgcattcattgggaagtgaactgcttaggacttactggaagaaaggatctcttttacaatattcagtgtccaccataaagaaatcctctgatggccgggattacaggcgtaagccactgtgctggccctctattatttaaatcgctttgttgacagtatgactgactgacatacaaaaagctgtaaatgatgtatacaggctgatgtttttggagatagtgttttgttttgttttgagacaaggtcttgctttgtcctccttggctggggtgcagtggcttaacaatcctctcacctcagcctcctgactaact

SEQ ID NO: 1614 - DNA, 552 bp, Homo sapiens
gagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattacccta

SEQ ID NO: 1615 - DNA, 864 bp, Homo sapiens
cggaaaccgggccgcggaggcacgatgagagccgtgagagccctagcacgacttgcccaaagacaatttctcaggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccaggg

SEQ ID NO: 1616 - DNA, 1486 bp, Homo sapiens
ctttcccgggggcagtctcttttctctcctcacctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaaattatggcctttgcaagcaaatgagtactcctctcctaaagaaagattacgttgatgaaaaagaacatcctgcccaggacccatcataca

SEQ ID NO: 1617 - DNA, 804 bp, Homo sapiens
cggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgcccagcaggagcttctgaacatgaagctatggaccatccacgagctgctgcaagatagcaagccggacaaggatatggaggcttcagaaccagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtct

SEQ ID NO: 1618 - DNA, 1016 bp, Homo sapiens
gggcggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcggtgaggagagcaatgattctgtgaatttttggggaatttgtggcaggagggaggaatggggacataggttgggagccactgagtggacatttcttcagtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatga

SEQ ID NO: 1619 - DNA, 899 bp, Homo sapiens
gtgcgcgttggggcggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatg

SEQ ID NO: 1620 - DNA, 771 bp, Homo sapiens
atggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgtgtgactactctggctggagcccagcaggagcttctgaacatgaagctatggaccatccacgagctgctgcaagatagcaagccggacaaggatatggaggcttcagaaccagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatga

SEQ ID NO: 1621 - DNA, 1324 bp, Homo sapiens
cggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcaggtgggtttagcagaagtctgtgctgggtcgggggagtttaggggacagcagaagatacataaccacttctgcccccttttttcccttatccccagagcaacagctggcccagttgacacaacagctggcccagacagagcagcacctgaacaacctgatggcccagctggaccccctttttgagcggtgaggagagcaatgattctgtgaatttttggggaatttgtggcaggagggaggaatggggacataggttgggagccactgagtggacatttcttcagtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatgatggagtgctcctgtgtgttttttcgatcctagttggttgtacacacccatactaggtgcctaaggacaactgggccttcttgaagagctgtccttattaggacaaaaagaggctgccttccagtgtgacagcagagaagatagagggagctccagctcttttcctcgtattcctgaggccaccagcatgcccgcgttcagggcccaaaaatccctt

SEQ ID NO: 1622 - DNA, 1242 bp, Homo sapiens
gggcggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatgatggagtgctcctgtgtgttttttcgatcctagttggttgtacacacccatactaggtgcctaaggacaactgggccttcttgaagagctgtccttattaggacaaaaagaggctgccttccagtgtgacagcagagaagatagagggagctccagctcttttcctcgtattcctgaggccaccagcatgcccgcgttcagggcccaaaaatcccttttctcatagcaaaactgagacagaagggtctttcccaaaaaaaagaaaaaaaactttactcaaatccagtggaaaaataaatgatagaaactatacacaacataaaaa

SEQ ID NO: 1623 - DNA, 2270 bp, Homo sapiens
agccgcggcgcgctgagcgagcaggcggggcgggagcgcccacagctcggagccaccaggcgctgacgaggagcccggctgagggaggatgcgccgctgacgcctgcgggagccgcgcgcctggggcgggaggatgctccagaggggcctctggccgtggcgcacgcggctgctgccgacccctggcacctggcgcccagcgcgcccgtggccgctgccgcctccgccccaggttttgcgtgtgaagctgtgtggaaatgtgaaatactaccagtcacaccattatagtaccgtggtgccacctgatgaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatctttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaagtattgtttgaagttctcaactgagatttttactttttggatttttatgacttgctaatgttagaaagggcttgtatgcgtctatcaaagcaacggtggctgctgttagctaaaaatccttgtcagcttgtcccacgtttattctctatgtggaggtgaaagggtctgtgcttggcattcacttccattcttagacttaatttggaatcatccttttaaaaaaatcagagaccaggtcttgccaaatcaaactcctgggctcaagcaaccctcctgcctcaacctcccacggaatcgtcttgtcattaacttctttttttaatatgcagtagttgggagtaagatctttttatcatttatcaaaaaggcataaatgttccaccaaccataaagtatagttggtactttttgaacttcaactgaaacagtgtatataaacgattgcttttgaacctgcaaatcacaagtttcaggtatcgaagccaaaacagttaactttcttcagcctctggcagattattaacaaaacagtattattcagattctatatcatattaataagaattgaaccttgaaagtaacatctgttattctattaatgtgattgtgtgtgaatgggtctgatgactgttggactgtttgtaggaacttaacatggaagatgctgacagaatcagattttgcaggtgttcaacctatagtggctaagaattatgttttctatttcatcctcagaatgccatacaacaattctggaatgctgattttttttaaagtaggaattaaagtcatacacaaaatgtggtaattcatatgtagatgaaatattaaacatttaaatgaccgagtaaaaaacatctatcaattacacaaatgaacaagaatgtgagttagaaaaatgtaataaaatatgaatttcgaatattttattaagggatgatttaattcctggatttcaaaaacctttaaaaacatcaaacaataaacttttataaaaaagtg

SEQ ID NO: 1624 - DNA, 2383 bp, Homo sapiens
ctccttttgctttttctggcgggaaaagctcacgcgcacctcccccaactcaactgccgttcgtcgttcgtggatgtccgttgtgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggagaacgggaagctgcttgccgagcgggatggagtgaaaaagagaagtcaggagctggccatggagaaggacactttgaagcggcagctctttgagtgtgaacacctcatttgccaaagagacaccatcctctctgagcgcactcgcgatgtggagagcctggcccagaccctggaagaatacagagtgacgacgcaggaactgaggctggagatttcacgcctggaggagcagctgagtcagacctatgaggggcccgatgagctacctgaaggggcccagctgagaagagtgggctggaccgagctgctacccccatcgctgggcttggagatcgaggccattcgacagaaacaggaagtggcaactgctgatctctccaaccctctgtgtggggtgtggcagtgggaggaagtcatccatgagaccagtgaggaaactgagtttccatctgaagccccagctgggggacagagaaacttccagggagagccagcgcaccctgaagaaggaaggaaggagccatccatgtggttgaccagaagagaggaagaggaggatgcagagagccaggtcacggctgatctccctgtccctctaggagcccctcgccctggagacatcccagaaaaccctccagagagacctgcgcggcgggaactccagcaagccctggtgcctgtgatgaaaaagctggtcccagtcaggaggagggcctggggccagctctgcctgcccccacagcggctcagagtcactcgacatccactgatcccagctcctgtcctgggcctgctgctgctgctgctgctctctgtcctgctgcttggcccgtccccacctcccacctggccccacctccagctctgctacctccagccccctccagtgtgagaggctctacttgcccctcagagcagtgtctagctcaataaatcccctggccctctctccactgggatccccattgttagtccactgttgcgcaggcttaccctagatagagtacaggggatccacatccctgtatttttatgtgaagtctcctagttttttaatgctgacatttcttaacaatagcaaaactcccccagtaatggattaagcactaaggattattccctcacaaaacaagcctggcgagggcagctgtgggcacacagctaagtctcggttgccttggggtcagggcctcagtgattctcctgtcccctccctcatgctcaggagttggcagttgtagcttcctacatcacatctgcgggaaacggaaatttcttccttcctttttataaagagaggcagtagcctcagtgtgcagtgggtagattcaaatcatattcataataaaagagaagcagttgcctgcccagagccaccagc

SEQ ID NO: 1625 - DNA, 565 bp, Homo sapiens
atgcgcacatagcgacttggtgggcgcgtccagtgatgactgggggatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccagagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttgatcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcaataaagaacacaaagctgttcccgtctgctgagt

SEQ ID NO: 1626 - DNA, 619 bp, Homo sapiens
gcgcacatagcgacttggtgggcgcgtccagtgatgactgggggatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttgatcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcaataaagaacacaaagctgttcccgtctgctgagtaaa

SEQ ID NO: 1627 - DNA, 401 bp, Homo sapiens
gcgcacatagcgacttggtgggcgcgtccagtgatgactgggggatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccagagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttgatcaggatcaagcaggcacttcaagcctcaataggaccaaggtgctggggtgtt

SEQ ID NO: 1628 - DNA, 3418 bp, Homo sapiens
attatgtaattttcccaaaagccccacctcgcctcagccgggcgggagagagggaggtctcgcgctttccccggggttgcgtcccgccccgcaggctgcgcgcaggcgctgacgagccgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaatctc

SEQ ID NO: 1629 - DNA, 2195 bp, Homo sapiens
agaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacaggagtcatagaggctgggtggtctggcaaggacttgtgcatttgagaactgacaggtgcagcggagacttctaagagggaaaaccaagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgcacaataaacattgcttgatgtttt

SEQ ID NO: 1630 - DNA, 1560 bp, Homo sapiens
tagaatcggaaccgtaggaggggtacttaaccggacggcctcccaggcctgtggccgtgcgcgggaagagcactgcagatctcaggatgatggggcgcagccctgggtttgccatgcagcacatcgtgggtgtgccccacgtactggttcggaggggcctccttggaagggacctcttcatgaccaggactctgtgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacttgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaatatcctgagttttattatttaaaacaa

SEQ ID NO: 1631 - DNA, 1506 bp, Homo sapiens
agacgattggtcgggccacgccagatctcaggatgatggggcgcagccctgggtttgccatgcagcacatcgtgggtgtgccccacgtactggttcggaggggcctccttggaagggacctcttcatgaccaggactctgtgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacttgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaatatcctgagttttattatttaaaacaa

SEQ ID NO: 1632 - DNA, 1385 bp, Homo sapiens
agacgattggtcgggccacgccagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacttgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaatatcctgagttttattatttaaaacaa

SEQ ID NO: 1633 - DNA, 556 bp, Homo sapiens
cgtccatctccttggcctgcttcttgggctgtttcagtggcttcttcttgccacctgtgggcgacacgagcacgttcggcctgcccctgccgcccggtccccaccccgccgtccccgcagtcctcacggttccggaacacttaccttcgcggccggacatggcgcctgccgccgcttccccagaccctgccaccggaaacggagcgtctgccccaccctctgtcgtagacagcgaggcggccccgctgattggctcctagtcaggaagttgaactctcgctaccggatgcggcgctccaggggcgggtactaacaggtcagaggtcaactgagtggcagacgattggtcgggccacgccagatctcaggatgatggggcgcagccctgggtttgccatgcagcacatcgtgggtgtgccccacgtactggttcggaggggcctccttggaagggacctcttcatgaccaggactctgtgcagcccaggcccaagccagcccggagagaaaagacctgaggaggtggccctggggctgcaccaccgcctcccagcac

SEQ ID NO: 1634 - DNA, 1554 bp, Homo sapiens
gccaggtacgaggagctagggttgtcctgccagggtagaatcggaaccgtaggaggggtacttaaccggacggcctcccaggcctgtggccgtgcgcgggaagagcactgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagagctcacaccccagtgacctcttctgggaatgcctcgctgggaatgcagctgagcctgtgtgggtgtggagagaaggtgcagatggcctccggttttctctttgcaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacttgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaata

SEQ ID NO: 1635 - DNA, 833 bp, Homo sapiens
aatttttttggccattttcatagatgatttttaaaaccacaggactggataagagaggagtctgagtgccgagtgccggggtgctacagtttccagaggttaggcagatgagtggggactggaaaccgagtgaaaaatggcatgtgaaggaggagcaggtgaaggccagatcagagggagctggacggaatcagagaagaggaacagaaacagtgaattcaggcagtctgtcaaggagtttggttataaaggaaaccaaagaaatggggcagttgctggtgggggggtgtcagatcaattactgagtaatgtctcaggaggagagaggatttgggacctggggcacagatctcaggatgatggggcgcagccctgggtttgccatgcagcacatcgtgggtgtgccccacgtactggttcggaggggcctccttggaagggacctcttcatgaccaggactctgtgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcag

SEQ ID NO: 1636 - DNA, 1461 bp, Homo sapiens
ggttgtcctgccagggtagaatcggaaccgtaggaggggtacttaaccggacggcctcccaggcctgtggccgtgcgcgggaagagcactgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacttgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaatatcctgagttttattatttaaaacaatcagac

SEQ ID NO: 1637 - DNA, 752 bp, Homo sapiens
gcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctgg

SEQ ID NO: 1638 - DNA, 720 bp, Homo sapiens
gtccaatatggcggcgcccagtggcggtgtgaactgtgaggagttcgccgagttccaggaattactcaaggtgatgaggacaattgatgacagaatagtacatgaattaaacactacggttccaacagcttcctttgcagggaaaattgatgccagccaaacctgtaaacaactttatgagtctttgatggcagctcatgccagtagagacagagtcataaaaaactgtatagcccagacttcagcagtagtaaaaaacctccgagaagagagagaaaagaatttggacgatttaacgttattaaaacaacttagaaaagagcagacaaagttgaaatggatgcagtcagaactgaatgttgaagaagtggtaaatgacaggagctggaaggtgtttaatgaacgctgccgaattcacttcaagcctccaaagaatgaataaagagagattcttttttttttttttttttttttttttttaaggactgggtcatctcataagagctaagcatgacagatatcaacagggcgggctttctaggatgatttctgagccaacagtccaagaccttttgttgatttcagccccacttagccaagacctcaagtataaataattctgataattatggagaaatcaactgctattttatactgattctgtaaaaaaaaaaaaaaaaaatttttgtaactattaaaataattttctgactcagtgta

SEQ ID NO: 1639 - DNA, 902 bp, Homo sapiens
aggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgaatctcactctttcatccaggctggagtgcagtggcacagtcttggcctactgcaacccccacctcccggtttcaagcgatcctcccacctcatcctcctgagtagctgggattacaggcatgcaccaccacacctggataatttttctgtatttttactagagacggggtttcaccatgttggccaggctggtctcaaactgctgacctcaagtgatccacccaccttggcctcctaa

SEQ ID NO: 1640 - DNA, 1240 bp, Homo sapiens
gcgcgcccggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagagagctaagcttgtctgctggatccctgcagctggagcgcaaaaggagagatttcacctcttctgggagcaggaaactctacttcgacactcatgccttagtgtgcttactggaagacaatgggtttgctactcaacaagcagaaatcattgtgtctgcattggtcaagatcctggaggccaacatggacatcgtctacaaagatatggtcaccaagatgcagcaggaaatcacttttcagcaagtaatgtctcagattgcgaatgtgaaaaaggatatgattattttggagaagagtgaattttcagccctcagagcagaaaatgagaaaataaaactcgaactacatcagttaaaacaacaagtaatggatgaagtgatcaaagtccgaacagataccaaattagacttcaacctagaaaagagcagagtaaaagaattgtattcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtga

SEQ ID NO: 1641 - DNA, 1550 bp, Homo sapiens
aggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaagttgtgtgggttttcaaagtgacttaccatatagttggagattgatttctttttggtaatgaactaaaacaataaattttaaaatgataggccaggcgcggtggctcacacctgtaatctcagcactttgggaggctga

SEQ ID NO: 1642 - DNA, 1919 bp, Homo sapiens
cccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctctttctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaa

SEQ ID NO: 1643 - DNA, 1986 bp, Homo sapiens
ccctcccaccggaaaactctgaggacatgaatagtcgccaggcttggcggctctttctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaaggtaatctgtgtttgagggtgtcctgttttcttttgtggcctgatcaaattttgattttgtttttttaggtgctggcctcgagcccaggtttttggtagacagcatcataaatttcaggccacgtctgccttattctcactggaattctcagtacatttcagtcacattgtagactttgggaaaataagtgaatactggaacccacaagtttccaacctgttggcacccctgttaacagggtgtcctgaagacatctaactttattcagagaaatgtttctagggctaggtttttgttgtcgtcgttgtttttcacccccagttttttaacttccctcccagtttttaaaccgttttaaggttgtccacaaaataggcgaataggcacctcttatctctgttcaccttcttgaatcttcagtgccagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattac

SEQ ID NO: 1644 - DNA, 4014 bp, Homo sapiens
cagcggccgaaaacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctctttctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaagttgtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgttacattctgattcatttttatctctattgcctaagagagttcttagtatattatagattaattttcactgagtcaattaataagttaccatatatattaaagtccactgtaacaaagtatactgcatttgttcagttaaccaatatgactgcctgctatatgccaaacagcatgctagtccctgtgtgcacagagatgaacatggtttcattctcattgaattgacaatcttaaggagagagacataaacaagtaaattattggtttgttaagatttaaaatattctaaaatattaagagggaatgcgtctttcctccatgtgaaggaagctccagtagcataacactgtcgtcactcttcatccccttatccactctgccctaggtaaagtgacttgcccaattgtaaatctggaaggagaaacaaggtgcaattagcccacttcctccccactcctgtttgggaccagcccatctgaagagacattcattctgttctgcttctatgggatcaggctctgcctctgcaggatgaggcctggcccagtagagcaatgcttgagacagggtaaatctgtccagttctagagttcagtgataagaagcttactggccttaagatgaaacccatattctcttgctgagcacagtggcacacatctatagtcctagctgcttgggaggctgcggcagcaggattgcttgagccaaggagttcatcaaggctaaagtgtaccatgatcatacctataaatagtcactgcactccagcctggcaacacatgagaccctgtctcctaaaaaaaaacttctccaatagttttatcagcaaataaaggtgttttttaggcctctatattagtttattcattcttcatcttagttatattcacaacccagaatggaaaggaggtatgccatttattggaccttctcaagccccaacaaataaatatacttattcccaggttatacagccactaaatattaaatagatctgcgttctttctcattgtaggggtttagcaaacaaagtgctttgtatccaataacagaagaatagaaatatgcataccataccctgtccccattacttttagatcctatatcctttccatgaaacttcattttgatggtggttctggggttcaggtaaatttttgtttcagtgatggaaatatatgaaataaggatgagaggattgtgtttctatatgccttaaaactatacctctattccagcacttgcacttcactatgaaacagcaattatacgtatctttttcctacactaaactacaagttctcagaaggcctctagacacatgtgaggtacttgttaaacgcctgtggaataaatgatactcataaa

SEQ ID NO: 1645 - DNA, 2228 bp, Homo sapiens
atgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactt

SEQ ID NO: 1646 - DNA, 2226 bp, Homo sapiens
aggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactt

SEQ ID NO: 1647 - DNA, 2334 bp, Homo sapiens
aggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactt

SEQ ID NO: 1648 - DNA, 1301 bp, Homo sapiens
aaatcaacttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcaggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaa

SEQ ID NO: 1649 - DNA, 471 bp, Homo sapiens
ctctcttgcctgcagccatgtaagttgtgcctttgcttctccttcaccttccaccatgattgtgaggcctccccagccatgtggaattttcctccttcacaggctcatgctctctctctcacctgccgccatgtaagatgtgcctgcttctccttctgccatgattgtaagtttcctgaggcctccccagccgtgcaaacctgtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactatt

SEQ ID NO: 1650 - DNA, 2440 bp, Homo sapiens
ggccttggcggaaatcaacttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcaggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 1651 - DNA, 575 bp, Homo sapiens
actgcggaggaaagctttggacatgaaacctatttttggcttcactttaaggagtggaactctattaaaagctgcgctggtgtttttttgagacagaatcgcctaagctgaagtgtagtggcgccatcatagctcactgcagcctccagctccttggctcaagtgattctcctgcctgagcctccctagtagctaggactacaggtgctatacgtggatgacctgcttagttttaatttttggagaaatacattttataaaacattttcatcagattgctaaaattgtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagca

SEQ ID NO: 1652 - DNA, 2738 bp, Homo sapiens
ttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcaggcttctaaccctcctttatgtgactcagagaaaggagacctcattccaagttccaggattaattctgatgaaagtattctgtctcatgcatctaatactttacttgtgaatgaagattcattatgaggtgctatacgtggatgacctgcttagttttaatttttggagaaatacattttataaaacattttcatcagattgctaaaattgtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 1653 - DNA, 835 bp, Homo sapiens
agcttggtgcgctatggcgacacccagcctgcggggtcgtctggcgcggtttgggaacccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgccatgccctctttggagggtagaagaggcaaaacacttttttcaccctttggaatcatagtatgggtagaagttatgatttatcttgaaataaaatcctctgaacagaacttggccttttgttgtgaattaggtactctcttcattcttgagcctcccctagaccctggaaattctttccttcctgatttgccctaggagcaggacaaataccgttgtattgtctttccctgcatttgaagtcttttacaccatttagtgcccttgcttttggatgcaataaggaagttgaagttgccttcgtctgtaaatacttagtgattgcctattttgtgcgtagtccctgcaaggtgctctctgaataataaagttaacaaactggtgaccta

SEQ ID NO: 1654 - DNA, 1202 bp, Homo sapiens
cgcaaagcctgccgggagcttggtgcgctatggcgacacccagcctgcggggtcgtctggcgcggtttgggaacccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggtgaccgatggctcctggggtgctttctcaggaaaagaatgggggagatagaagtaatgattctccctgccttttgctaggaaaggccctttcattcatttgggaggtatattattcacgccaaagtgggaaaggttacagttttgaaggctgtgtgatcttgacggatttattcattgctctgaactttcgagttactgtacgtaaaatgaggctaaccaataccaccttaaagaatgttgtgagtgtcagatgaagtaatgaatgggaaaatcattttgaaaaatgtaaattgctgctcaagtagacattattgtgtgaaatagaactaaagagactaaaactaaataatgacaatagtttggtttcctgtctaggcttaattgttagctgagatagtagcttctgaacatagtctcatttgtaggtcccaacgcccttttgttgaaaagaggctgacatagatctctccaggctggttaacatcttcatgtgctttagggcattgtgagaactatgggcctacatcaggacaaacttgattgattgattggttttttgggtcagatcttaaaagtctggactagacaaactgtagagctgtcattcttgtatttgttttgtgttttcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgccatgccctctttggagggtagaagaggcaaaacacttttttcaccctttggaatcatagtatgggtagaagttatgatttatcttgaaataaaatcctctgaacag

SEQ ID NO: 1655 - DNA, 1171 bp, Homo sapiens
cagggccgcgcttcacttccctaggccaccggagactcccaggccacgcggtggtcagcagaccctgtctggagggaggggacagacagccgagtccgggagggggcagagagcggagtccagcctggagcctcgcgtccccttcccagctggccccatcccgtcgcctccccgtctcctctcccctccagggctcgcaacaacccccaactccgctccctgccctctgcggtggtcctaacagaaggcactgtcgccctccttaagccctcggcgctttgcgacactggcccctgtccccagaacccgcacagcctgccaggcgcagggagggagcagggtcccatttccagccgagacccggagctgctggaagggagatgtccggaggacgggagaagggggatagggttgggggcagtgccgcctcccgctgggggcgtgttcctgaggccccgcccggggccccgccttttttgcgccggctgtgacaagcgctgcggcatttgtccccgcgacagcaccgctgccgccgtctctaaggtcgcccgggtcccaccgccgccaccatgcctcggggaagccgcagcgcggcctcccggccagccagccgcccagccgcgccctctgcccacccgcccgcgcacccaccgccctcggcagccgccccagcccccgccccttcgggccagccggggctcatggctcagatggcgaccacggccgcaggggtagccgtgggctcggctgtgggacacgtcatgggcagcgccctgaccggagccttcagcggggggagctcggagccctcccagcctgctgtccagcaggcccccacccccgctgccccccagcccctgcagatggggccctgcgcctacgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccaca

SEQ ID NO: 1656 - DNA, 901 bp, Homo sapiens
cttcaggcctgcggagacgacggagaacggaagttctctgcctgtgtgctggttggttgcgcgttgaggccagccccgcctcccatcttccggtctcctcagaagtcgcttagctcttcggtggttgtcccacgtccggaggcctagccgtcgcttacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctggcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaggta

SEQ ID NO: 1657 - DNA, 1600 bp, Homo sapiens
agtttccggctgaggttggcctggccgcggttgcgagggcgccgaggcaggcgcgcggcgggcaggcctgggagggggcgggtccgcgcgggcttcggaggagcccgccctgccagaggagagggaggtcacggcgtaaaggtgcagctgccgccaccgccgcttctgcaaggtctcagggacgggctgcagccatgtcctattgccggcaggaaggctttgcccaggatggttccttctggaatgtctattcccctccttccctccctgaagctctttgtcagggacaaaggtaggatccctccccttccgtcttctccactggatgcctgtgtcgtattcatctgtgaccaccaggtactaccacagagctggagctgaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacatcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttctacc

SEQ ID NO: 1658 - DNA, 1405 bp, Homo sapiens
aggttggcctggccgcggttgcgagggcgccgaggcaggcgcgcggcgggcaggcctgggagggggcgggtccgcgcgggcttcggaggagcccgccctgccagaggagagggaggtcacggcgtaaaggtgcagctgccgccaccgccgcttctgcaaggtctcagggacgggctgcagccatgtcctattgccggcaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacatcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaa

SEQ ID NO: 1659 - DNA, 2088 bp, Homo sapiens
ctgtgaggtcagatagtggtctagagcataagacttaacttattgccggaaacagagagagaacagaagaagagaaagctcagcaaattttcttgccatacttcatgacttcactgtggctaagtgtggggaccagacaggactcgtggagacatccaggtgctgaagccttcagctactgtctcagttttttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtgaaaatgtggagcagccaacaagcaggggctcttaggcaatcacatagtgaaagtttataagaggatgaagtgatatggtgagcagcggacttcaaaaactgtcaaagaatcaatccagcggttctcaaacggtacacagactattgacatcagcatcacctagaaacttgttagaaatgcaaattctcaagccgcatcccagacttgctgaatcggaatctctgggggttgggacccagcaagggcacttaacaaaccctcgtttctgattaatgctaaatgtaagaatcattgtaaacattagttctatttctatcccaaactaagctatgtgaaataagagaagctactttgtttttaaatgatgttgaatatttgtcgatatttccatcattaaatttttccttagcattgtctaagtcttccagattccatt

SEQ ID NO: 1660 - DNA, 567 bp, Homo sapiens
agacaggactcgtggagacatccaggtgctgaagccttcagctactgtctcagttttttggtaagaaaacctagacctacctgatgacttgtgcttagcctgttttgctcattatagaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctg

SEQ ID NO: 1661 - DNA, 2342 bp, Homo sapiens
cttgggcaggagggaccttcgatcctcggggagcccaggagaccagaacatggactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggctggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacggggataatgatgtccttcctggagccatcgtcacccaccttcctgctgctgaagaagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtaggcgacagcctcatgggccactgtggcccgatgtccccttccttcccggccattctccctcttgttttcacttcacttttcgtgggatggtgttaccttagctaactaactctcctccatgttgcctgtctttcccagacttgtccctccttttccagcgggactcttctcatccttcctcatttgcaaggtgaacacttccttctagggagcaccctcccaccccccaccccccccacacacaccatctttccatcccaggcttttgaaaaacaaacagaaacccgtgtatctgggatatttccatatggcaataggtgtgaacagggaactcagaatacagacaagtagaaagattctcgcttaaaaaaaatgtatttattttatggcaagttggaaaatatgtaactggaatctcaaaagttctttgggacaaaacagaagtccatggagttatctaagctcttgtaagtgagttaatttaaaaaagaaaattaggctgagagcagtggctcacgcctgtaatcccagaactttgggaggctaaggtgggtggatcacctgaggtcaagagttccagaccaggctggccagcatggtgaaaccccgtctgtactaaaaatacaaaaaattaactgggcatggtagtgggtgcctgtaatcccagctacttgggaggctgaggtgggagaattgctcgaacttggaggtggaggttgtggtgagccatgatcgcaccactgcactctagcctgggtgaccgagggaggctctgtctcaaaagcaaagcaaaaacaaaaacaaaaacacctaaaaaacctgcagttttgtttgtactttgtttttaaattatgctttctattttgagatcattgcaaactcaacacaattgtaagtaatgatacagagggatcttgtgtacccttcacccagcctcccccaatggcaacatcttgcaaaactacaatgtagtctcataaccaggatattgacattgatacagtgaagatacaggacattctcatcaccacagggatccccaggatgcccacttccctccacccccacaccccagccgtgtccctaacccctggcaaccaggaatccactctccatttctataatgttgtcatttcaagaatgttattcaatggaatcatatagtatgtaacctgttttgagcttaaaaaaaaagtatacatgactttaatgaggaaaataaaaatgaatattgaaatgtt

SEQ ID NO: 1662 - DNA, 2083 bp, Homo sapiens
gggcgggcccgggcgggggcgggcggcgggcggtgccaagcgtggggcgcgggcccgcggcgggagctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagatggagcgggatgcacagttcacacagaggaaggcagagcgggccacactgcggagccacttccgagacaaataccggctacccaagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtgtgcctaccttcccacttcttactggcttccaggagtcttggagttcatagccccccgagcctgccttaaaggggtgtcctccaccccccacctacagcttcacaggaggggagaaggcatccagtgctaggagtagaagtgtctccagctctgttctcttggggccctgggtgaaggtggggtctggggcttatgaaataggtctgggctttgaggaggatggagcagcctcattatgtggggaagatggggcctctggggcgtcactgagaccacaggtggggccggggctggaccgcagctgtcttgggtgcctgtgcctacacccctcctcaccctagagacggaagatgtgcaaaaagaaagaaggaagggcaactgcattccagccccacactgtgatgactttgagcctgtcctttccctccttgagcctgtcttgcttgtcccctgtaaaatgaacagtccccctctcccccaaatagtaataatacatgtttcaaagggtgaccatttataaagcatatgacaaaccatatcaataaatgtaactcattcttttaaaaaaa

SEQ ID NO: 1663 - DNA, 2625 bp, Homo sapiens
atcttgccgtctgtgtgagcccaggtatgcagtaggctccgcccaggacccagcccggcccctccttaggcctgggctctgggagcggaaattccggcgacagcagggcaaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaatg

SEQ ID NO: 1664 - DNA, 2538 bp, Homo sapiens
ggcaaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgcgtgaggagagggacatggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaa

SEQ ID NO: 1665 - DNA, 994 bp, Homo sapiens
gaaattccggcgacagcagggcaaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatctgcagccacgtggctgggatctgccacaacatcctggtctgctgccccaaggagctgctggaacagaaggccgtgctcgagcaggtgcagctggacagtccattgggcctagaaattcacaccaccacccccacacctgccttcagaccccccccaacaggcaccttcccctgctgcgcccccctagctcccttcagacccccccacaggtacctgctcctgctgctcccctacccctgttgccccccaacctgctttcagacccctgtctccattgctttgttcctggttgttccccagacgccccctcaggtcctggactccccgcaccagaggagcccatcactgtctctggccccactgtctcccaggtaacaggctctgtccaggtgtgtcttggtggggagaccgtgggctcatctcatcccccttgccctccccagggccccatctga

SEQ ID NO: 1666 - DNA, 5453 bp, Homo sapiens
aagagcggaggaccaggaaccagagagagagagagagaaaagagagaggagagacagagcgcttgggggcgaaaggagagagggagggaagggtgggtaaggaggagagagcggtctgctgcaaaccccaggaggagagcttggagcccaagccagaactcgagccctagccggagccgttcacagggaggcggctgccgggaccgtcagccctgcatgatgcatctccggctcttctgcatcctgctcgccgcggtctcaggagccgagggctggggctactacggctgcgacgaggagctggtgggtcccctgtatgcacgctccctgggcgcctcctcctactacagtctccttactgcgccgagattcgccaggctgcacggcataagcgggtggtcaccacggattggggatccgaatccctggctccagatagacttaatgaagaagcaccggatccgggccgtggccacacagggctcctttaattcttgggactgggtcacacgttacatgctactctacggcgaccgagtggacagctggacaccgttctaccagcgagggcacaactcgaccttctttggtaacgtgaacgagtcggcggtggtgcgccatgacctgcacttccacttcactgcgcgctacatccgcatcgtgcccctggcctggaacccacgcggcaagatcggcctgaggctcggcctctatggctgcccatacaaggccgacatactctatttcgacggcgacgatgccatctcctaccgcttcccgcgaggggtcagccgaagcctgtgggacgtgttcgccttcagcttcaagaccgaggagaaggacggtcttctgctgcacgccgagggcgcccagggcgactacgtgacgctcgagctggagggggcacacctgctgctgcacatgagcctgggcagcagccctatccagccaagaccaggtcacaccaccgtgagcgcaggcggagtcctcaatgaccagcactggcactatgtgcgggtggaccgatttggccgcgatgtaaatttcaccctggacggctatgtgcagcgctttattctcaatggagacttcgagaggctgaacctggacactgagatgttcatcggaggtctggtgggcgccgcgcggaagaacctggcctatcggcataacttccgcggctgcatagaaaacgtaatcttcaaccgcgtcaacatcgcagacctggccgtgcggcgccattcccggatcaccttcgagggtaaggtggcttttcgttgcctggacccggtaccgcaccctatcaacttcggaggccctcacaacttcgttcaagtgcccggtttcccacgccgtggccgcctggcagtctcatttcgcttccgcacctgggacctcaccgggcttctccttttctcccgtctgggggacgggctgggccacgtggagctgacgctcagcgaagggcaggtcaacgtgtccatcgcgcagagcggccgaaagaagcttcagttcgctgctgggtaccgactgaatgacggcttttggcacgaggtgaattttgtggcacaggaaaaccatgcagttatcagcattgatgatgtggaaggggcagaggtcagggtctcatacccgttgctgatccggacagggacctcatatttctttgggggttgtcccaagccagccagtcgatgggactgccactccaaccagacggcattccatggctgcatggagctgctcaaggtggatggtcaactggtcaacctgactctggtggagggccggcggcttggattctatgctgaggtcctctttgatacatgtggcatcactgataggtgcagccctaacatgtgtgagcatgatggacgctgctaccagtcttgggatgacttcatttgctactgcgaactgacgggctacaagggagagacctgccacacacctttgtataaggaatcctgtgaggcttatcggctcagtgggaaaacttctggaaacttcaccattgatcctgatggcagtggccccctgaagccatttgtagtgtactgtgatatccgagagaaccgagcgtggacagttgtgcggcatgacaggctgtggacaactcgagtgacaggttccagcatggagcggccattcctgggggctatccagtactggaatgcatcctgggaggaagtcagtgcccttgccaatgcttcccagcattgtgaacagtggatcgagttctcctgctacaattcccggctgctcaacactgcaggaggctacccctacagcttttggattggccgaaatgaggagcagcacttctactggggaggctcccagcctgggatccagcgctgtgcctgtggtctggaccggagctgtgtggaccctgccttgtactgcaactgtgacgctgaccagccccagtggagaactgacaagggactgctgacctttgtggaccatctgcctgtcactcaggtagtgataggggatacgaaccgctccacttctgaggcccagttcttcctgaggcctctgcgctgctatggcgatcgaaattcctggaacaccatttccttccacaccggggctgcactacgcttccccccaatccgtgccaaccacagcctggatgtctccttctacttcaggacctctgctccctcgggggtcttcctagagaatatggggggcccttactgccagtggcgccgaccttatgtgcgggtggaactcaacacatcccgggatgtggtcttcgcctttgatgtggggaatggggatgagaacctcacagtacactcagacgactttgagttcaatgatgacgagtggcacctggtccgggctgaaatcaacgtgaagcaggcccggctccgagtggatcaccggccctgggttctgcggcctatgccactgcagacctacatctggatggagtatgaccagcccctctatgtgggatctgcagagcttaagagacgcccctttgtgggttgcttgagggccatgcgtctgaacggagtgactctgaacctggagggccgtgccaatgcctctgagggtacctcacccaactgcacaggccactgtgcccaccctcggctcccctgtttccatggaggccgctgcgtggagcgctatagctactacacgtgtgactgtgacctcacggcttttgatgggccatactgcaaccacgatattggtggtttctttgagccgggcacctggatgcgctataacctacagtcagcgctgcgctctgcagccagggagttctcccacatgctgagccggccagtgccaggctatgagcctggctacatcccgggctatgatactccgggctatgtgcctggctaccatggccccgggtaccgcctgcccgactacccccggcctggtcggcctgtgcccggttaccgtgggcctgtctacaacgttacgggagaggaggtctccttcagcttcagcaccagctccgcccctgctgtcctgctctacgtcagttcctttgttcgtgactacatggctgtgctcatcaaggatgatgggacccttcagctgcgatatcagctgggcaccagtccctacgtgtaccagctaaccactcgaccagtgaccgatggccagccccatagcatcaatatcacccgtgtttaccggaacctcttcatccaggtggactacttcccactgacagagcagaagttctcgctgttggtggacagccagttggactcacccaaggccttgtatttagggcgtgtgatggagacaggagtcattgacccggagatccagcgctacaacaccccaggtttctcaggctgcctgtctggtgttcgattcaacaacgtggctcccctcaagacccacttccgaacccctcgacccatgactgctgagctagctgaggcccttcgagttcagggagaactgtccgaatctaattgcggagctatgccacgtcttgtttcagaggtgccacctgagcttgatccctggtatctgcccccagacttcccctactaccatgatgaaggatgggttgccatacttttaggctttttggtggcctttctgctgctggggctggtgggaatgttggtgctcttctatctgcaaaatcatcgctataagggctcctaccataccaatgagcccaaggctgcccacgagtaccatcctggcagcaaacctcccctacccacttcaggccctgcccaggtccccacccctacagcagctcccaaccaagctccagcctcagccccagccccagccccaactccagccccagcccctggcccccgggatcagaacctaccccagatcctggaggagtccaggtctgaatgagtcagaagggcttctgggaccaattccagctcctgacattcccccagtcctgcctctcccccatcctatcagggacatttggctcctcttagctggctctgctcatccagaggatattcccccatcccccccccatcaagtttggtgggcagagctacagatgggacccaagggagtggccgagcctcactgcctaaaccaatgcccttctcatccctgtttccccaggctcctggctgtttatctgccccaaaggagaagcctcatggggttgacataggtcctttctgccatctctgttccagctgctgtcagggattaacaacagagtgtaggggagattaactgcctcccttccaatagacactatcagcagggacagatgtgtgggagtgcagggctgcagagggtatggggggaggaggctgctaaaccctatcccccagcctcccccctgccctgaagatcttccatttgcttccactcagctggaggctcaagagggcttgatggctgtcccctgcccccctccttttgttttgtacacagagaccaagaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattcgaatttttaaattatttgtttatatataaaagaaaagctcaattggctgtgctgtcctgtgctgtgctgtgcccacagtctgtagtttgcctttcctgtgttggaagtgtcgtgagtcctgctggtcacccaccagcctggtccggcctccactctgaagcagggttgagcctgctgtgctctcagacgcggagccgttccaataaagcagagtggcagagcccc

SEQ ID NO: 1667 - DNA, 3213 bp, Homo sapiens
taacgggaggagagcgccaggcggagctggggcgtccctcccgctcgcttcttgactcgcgttggtgccggccgcctcccgcgcctagtgtccgggacgcgcctgaacctgccgcctccgtgcctggggcggcgccgcgcggcccccaggctcccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatggagttggctcatgggttgcaggaccaaaacctgaaaatatctctgactgtgtgtcaccagaccacacaatgaatacatcacttaggttagcatgagaaaaggggaaaaacagctgtgaagcccatgaactttccaagaaggtaaaggagaaaaaaaaaaaaaagttgggtttgaagtctaagttttactatgaacagcaccctgctgagatcataaaaatgaaaaataccatcaagatacatgaaaaaggaaacaccaaagggaagagtgataacaaggctccacagagcgcagtttcctttgacaagatgaaaaagaaatgaaaagaggaaggagataaatggaacagccctctacctaaagtttctgtccatggagaaactgacatttaagtgctgctcaacaggaaaaagaaaaaagacctggttattgaagttggctttgttggagatgcgttactcagatacagatacaaagatgggtttggccaatgggcatccgtgtcaagaagcctgacctaacacgttctgaatattaagctaccttttatctgccagtccttggtgttcagaagaatccctcctcctcaccctaacttctatggggctatttccaaagacactgtcattgaagtgaggaagagtgagttgggccttatgacacaaagagacaagactatttgaggacaatagacacaggttttcatatacattccatgttattctgaattactgatgggttcgctgatggaattattgagtatagccaataaggagaaccacagttaagctggtgtctctgggttctggatatcatcctcaagaaaactatttactaattacattgaatgaggttattaaaatgtgtaagtttcacacaaaaacaaaaagacaattcattccaaattgtgcatatggatatataatgttaattatgggaattccattttaagaattactacaattctatgtgttctgtataaaaacaggaaaatagttgttccaatatataaaaggaaaacatttaaaaatgtattttcttgggaaaatcagctgccagaattcattagtcaactaacaagcactcctctgtggcaagaagccctgcttctctgttgtagcaggcagctacccacctaaatgatgaggtcaagaaatatacagctgataaaaagataaaaaatatgtaatagtccagtgattacatgtgtactacggatcagcgccaattagttgtaagcttttggtatttagttcgttacagcaaatgttttcttttttaaattttcttctgcaaatgttttcttgtcatgaaaagtgttttccgtttagcagaattacaaaaatagtcaagaagaaatgttctgattgatgtatacagttagaatgtgtattaaagattattataaaatgataactgaattatatccatttctaaagtatgttgggacaaaattttttaaaaatgtgattctgttttgaaaattgttttaccactggatcagtgtggttcttaaacttggctttatcttggagtcaccagaggagattcaaaagatacctttacctggctccacctccagagatcgggattttaaatggtctgtatctggattttaagagcccttctggtgattcgactgtttagctaggtttgagagccactaccctagatgagctgtcctgctccagtaacattctttttctaaaatcttttatagtatattagaaataaatccatggaaattccaagtaaaa

SEQ ID NO: 1668 - DNA, 2650 bp, Homo sapiens
ccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccatccgggctttactatattgatgcagatggaagtggccccctgggaccatttcttgtgtactgcaatatgacagcagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggtgatttccacatgatttccctgcacaaaaatgtggtttttattctttaattatgcatagttaattaaatgtcagacaagctggtacaataaggtaactagattaaagtatgttcaagcaagctgaaatacaagttttgatgaaatatgatcagttaatctaaggattaaattttatgacc

SEQ ID NO: 1669 - DNA, 4860 bp, Homo sapiens
cggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccatccgggctttactatattgatgcagatggaagtggccccctgggaccatttcttgtgtactgcaatatgacagcagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggactagtgacacaatagtcctttcccaaaaggagcacctcccagtcactcagattgtgatgacagacacaggccaaccacattccgaagcagattatacactggggccactgctctgccgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcgggctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatgagatttccgcatattttgcaactggctcctcaatgacataccattttcaagaacattacactttaagtgaaaactccagctctctcgtttcttcattatacagagatgtaacattgaccagagaaatgatcacactgagcttccgaaccacacgatctccgagcttattgctgtatgtgagctctttctatgaggaatacctttcagttatcctcgccaacaatggaagtttgcagattaggtacaagctagatagacatcaaaatcctgatgcatttacctttgattttaaaaatatggctgatgggcaacttcaccaagtgaagattaacagagaagaagccgtggtcatggtagaggttaaccagagcgcaaagaaacaagtcatcttgtcctcagggacagaattcaacgccgtcaaatctctcatattgggaaaggttttaggtcgttctggaccagtggatgagggagagcccttggttaatgcagacagaagagactctgctgtcatgggaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattagttatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaaatagcttaactg

SEQ ID NO: 1670 - DNA, 5256 bp, Homo sapiens
gaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccatccgggctttactatattgatgcagatggaagtggccccctgggaccatttcttgtgtactgcaatatgacagcagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggactagtgacacaatagtcctttcccaaaaggagcacctcccagtcactcagattgtgatgacagacacaggccaaccacattccgaagcagattatacactggggccactgctctgccgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcgggctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatgagatttccgcatattttgcaactggctcctcaatgacataccattttcaagaacattacactttaagtgaaaactccagctctctcgtttcttcattatacagagatgtaacattgaccagagaaatgatcacactgagcttccgaaccacacgatctccgagcttattgctgtatgtgagctctttctatgaggaatacctttcagttatcctcgccaacaatggaagtttgcagattaggtacaagctagatagacatcaaaatcctgatgcatttacctttgattttaaaaatatggctgatgggcaacttcaccaagtgaagattaacagagaagaagccgtggtcatggtagaggtaatcccacaaatgcaaaagtcaaactaactaatattattattttgagaacaaataatctaatgaaaaaatttgacaataaatattaatagaagagcaacccattcagtgctgctcttccataagtcaagaagaggccaaatatggccaggatctgggagagaggaggtggttgtttattctgtattgctttgttttgtttgtttagcaatgcaattctgtcaaaggtattattaatattttactatttaaaatatcaaaatatctttatttgttttactttactcaataggggaatgttctctagtttatcatagtgactactggtggaatctattcattgatattgcagtgggaacttgtcttattccgattataaaagaacaaatactttagcaacttaaaaacacggtttaaaagcacacaacatagttattaaaatgggaataagtaagaaaatagacctgagtcaccacagaggaagtaaattacacattgtcattggcattggaaggaaaatacactgtatagagaacagcagtgcttggttttatgtttcatattttctccacagaatgagtacgtatttaagtttaaaacagccagttccatctttttcatggattctgccaattatagatccttccattatgaagaagagtaaagccagcaagtaggtacatcgtggatagagtggtagctgatggcatcataggaattgcttataaaatagcttccccttctaaatgattaattatttgaaggtggcttcttgagcttttgtagtggtacttaaaagtgatttattttcatctttcctttcctcatcttcctttgcttccttatcattaaaattgtactttgtgttgatgtttgcttctcatgggacatctaataggttaaccagagcgcaaagaaacaagtcatcttgtcctcagggacagaattcaacgccgtcaaatctctcatattgggaaaggttttaggtaagtaggagaaagagctttttcccaaaaaatctaagtgtcatgtcacaaactctggaagcattcatcatgctgaaagaagctccttgtcttacttgaataataatttcacagtgagtgacaatcaaggtgcaaactgtactcttgcctgagtgtacatataatcatgagtaagtgctgcctgtgagatgtgcaagggcgttcctggaaaaatacctccacacttaacctctcacttggcaatcatgcataatgaatcacggtatttttctaaaccttcttgaaaagtgaaatgttatcaaagctgacacgaagttcacagattatgtatgtattaatcaacatcaactccggagaccatcattcaatgataaaactacatttgaggtgaacacaagagaaaaaactggtaatcttattacagcagatgaatacagttttatttctctctcaagccctgctttgcctgttgcttccatcctttttgactttagtatctaacaggaatggggaggcatattcataaatatctgttacgcaaggtagaaagttacagtaattgtctatcatattgtctatcataacctgttgtaaaagcacagttagctttacatttaataaaggaactgaggaaagtaatcttttttaaaaaaaacccatcttatgtaactcaattaagaaaatgaactatactttaatattaggatcaaaaagttgaataatatttattatatacatctttgtttccttccaaataaaggagaacatgg

SEQ ID NO: 1671 - DNA, 7939 bp, Homo sapiens
tgccggtataacgggaggagagcgccaggcggagctggggcgtccctcccgctcgcttcttgactcgcgttggtgccggccgcctcccgcgcctagtgtccgggacgcgcctgaacctgccgcctccgtgcctggggcggcgccgcgcggcccccaggctcccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccatccgggctttactatattgatgcagatggaagtggccccctgggaccatttcttgtgtactgcaatatgacagcagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggactagtgacacaatagtcctttcccaaaaggagcacctcccagtcactcagattgtgatgacagacacaggccaaccacattccgaagcagattatacactggggccactgctctgccgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcgggctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatgagatttccgcatattttgcaactggctcctcaatgacataccattttcaagaacattacactttaagtgaaaactccagctctctcgtttcttcattatacagagatgtaacattgaccagagaaatgatcacactgagcttccgaaccacacgatctccgagcttattgctgtatgtgagctctttctatgaggaatacctttcagttatcctcgccaacaatggaagtttgcagattaggtacaagctagatagacatcaaaatcctgatgcatttacctttgattttaaaaatatggctgatgggcaacttcaccaagtgaagattaacagagaagaagccgtggtcatggtagaggttaaccagagcgcaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcggcgggggcggcgtccggctccccggcgcgggaactggctccccgactcgcggggggcgcaggtcgttctggaccagtggatgagggagagcccttggttaatgcagacagaagagactctgctgtcatgggaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattagttatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaaatagcttaactgaagatcactaattccttttctaaattttgaactgctctaggcataaatatcattgtgtattatcctttcatctaatcacttttggaatgtaaactgaaggctgttcactccaagttaagttaacatttacatgatgtttattaaatctgccagtctgatcaaaggtttatgaccatggggccaaattcccatagattacccaaaattgaatatgtgcagttaactggaacatgtctcattaaggtttacatacacactaagacagcaaaggattggaattaactttatggagacagttccagggactaatattgaagcagtggttatttgataatgcatggaaccaccatttggattcaataaaccaattacataaaagcaatgatgctacgctcttcatattccagataccaactgcctaccaaggactaatgagatggtatatttcttccacatcagggcaagctgaaaatatattgattcagcgttactgttatgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaagaaaaagagataaatatttactgattgctagatgtaaaaatatctatgaatatatatatttaaacttctgccagagagcaaccatctgacagtcaacttactaaaatctaaattgagtactttttactgttgcagagaattaagtcactaaacattatttagatatatagatgctagttgcaagtaacacccttttgtaatataaaagtaaaagcataataatttcccaacttttgtcttcaaattaaaaaagaaaatagcatataattaccattcttcatttgagaaagctgaagattctgatgcttaaaaacttcagaattctaatattaaaaatagagtggttcatgtgacattgaaggcttatctctgtaaaatagtgacactggtgagtggtattatctcaatatttttgtccaaattcaccttaggaaatcactgtaaatcttcattgtttcctaaaagtcattattacggcataaacttaacatactttgatagtagttagtactgatacgtgacatattctaccccgtgtctctgttactctgtctctattactgtgaaaagtcacagtaaatttaacattttcttccagactgtgtatgatctttcattgtaatagagacatggagtaggataagtcatgtattaacatataagatttttttaacctgctccctcagttttatagatgagacaaagataaggttgtaagagctaatctcttcaagtaggcagtactagtaagttgtcatgcgtggactgaactcctggcacttctttctcttaacttcaatccatagagaagcccaccttcctgccttcccagtattatttagcagaggagaaaatcatattaggctgtttgatactctgtttgcctagactgaccaataattctggatctttgttcacatcttctctgaaagaatatttgatgggaaatcttttttattttttaatttttgtgtacatactaggtgcatatatttatggagtacatgaaatgttttgatacaggcatgcactgtgaaataagcacatcatggagaatggggtatccatcccctcaacatttatcctttgtgttacaaacaacctgattacactctgtattttaaaatatgcagttaagtttttattgactatagtcaccctattgtgctatcatatagtaagttttactcattctttctactttttttgtacccattaacctatccccacctctgccccaccattatctcagctgtctactacttttttcagcctttactaaccatccttctactctatatccatgagttccgttgttttggtttttagatcccacaaataaatgagaacatggcaatgtttgtctttctatgcctggcctatttcacttaacataatgacctccagttccatccatgctgtcgcaagtgacaggatctcattctcttttatggctgaagagtactccattttgtatgtgaaccacattttcttcattcatctgttgatgaacacttagggtgtttccaaatcttagctgttataaacagtattgcaacaaataaaagagtgcagatgg

SEQ ID NO: 1672 - DNA, 1903 bp, Homo sapiens
cggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggagctctctacgagcagtcttgtgaagcccacaagcaccgagggaacccatccgggctttactatattgatgcagatggaagtggccccctgggaccatttcttgtgtactgcaatatgacagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgaggt

SEQ ID NO: 1673 - DNA, 5284 bp, Homo sapiens
gattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactacaactgtgatgatccactagcatccctgctctctccaatggctttttccagttcctcagacctcactggcactcacagcccagctcaactcaactggagagttggaactggcggttggtccccagcagattccaatgctcaacagtggctccagatggacctgggaaacagagtagagattacagcagtggccacgcagggaagatacggaagctctgactgggtgacgagttacagcctgatgttcagtgacacaggacgcaactggaaacagtacaaacaagaagacagcatctggacctttgcaggaaacatgaatgctgacagcgtggtgcaccacaagctattgcactcagtgagagcccgatttgttcgctttgtgcccctggaatggaatcccagtgggaagattggcatgagagtcgaggtctacggatgttcctataaatcagatgttgctgactttgatggccgaagctcacttctgtacaggttcaatcagaagttgatgagtactctcaaagatgtgatctccctgaagttcaagagcatgcaaggagatggggtcctgttccatggagaaggtcagcgtggagaccacatcaccttggaactccagaaggggaggctcgccctacacctcaatttgggtgacagcaaagcgcggctcagcagcagcttgccctctgccaccctgggcagcctcctggatgaccagcactggcactcggtcctcattgagcgggtgggcaagcaggtgaacttcacggtggacaagcacacacagcacttccgcaccaagggcgagacggatgccttagacattgactatgagcttagttttggaggaattccagtaccaggaaaacctgggacctttttaaagaaaaacttccatggatgcatcgaaaacctttactacaatggagtaaacataattgacctggctaagagacgaaagcatcagatctatactggcaatgtcactttttcctgctccgaaccacagattgtgcccatcacatttgtcaactccagcggcagctatttgctgctgcccggcaccccccaaattgatgggctctcagtgagtttccagtttcgaacatggaacaaggatggtctgcttctgtccacagagctgtctgagggctcgggaaccctgctgctgagcctggagggtggaatcctgagactcgtgattcagaaaatgacagaacgcgtagctgaaatcctcacaggcagcaacttgaatgatggcctgtggcactcggttagcatcaacgccaggaggaaccgcatcacgctcactctggatgatgaagcagcacccccggctccagacagcacttgggtgcagatttattctggaaatagctactattttggagggtgccccgacaatctcaccgattcccaatgtttaaatcccattaaggctttccaaggctgcatgaggctcatctttattgataaccagcccaaggacctcatttcagttcagcaaggttccctggggaattttagtgatttacacattgatctgtgtagcatcaaagacaggtgtttgccaaactactgtgaacatggaggaagctgctcccagtcctggactaccttctattgtaactgcagtgacacaagttacactggtgccacctgccacaactccatctacgagcaatcctgcgaggtgtacaggcaccaggggaatacagccggcttcttctacatcgactcagatggcagcggcccactgggacctctccaggtgtactgcaatatcactgaggacaagatctggacatcagtgcagcacaacaatacagagctgacccgagtgcggggcgctaaccctgagaagccctatgccatggccttggactacgggggcagcatggaacagctggaggccgtgatcgacggctctgagcactgtgagcaggaggtggcctaccactgcaggaggtcccgcctgctcaacacgccggatggaacaccatttacctggtggattgggcggtccaatgaaaggcacccttactggggaggttcccctcctggggtccagcagtgtgagtgtggcctagacgagagctgcctggacattcagcacttttgcaattgcgacgctgacaaggatgaatggacaaatgatactggctttctttccttcaaagaccacttgcctgtcactcagatagttatcactgataccgacagatcaaactcagaagccgcttggagaattggtcccttgcgttgctatggtgaccgacgcttctggaacgccgtctcattttatacagaagcctcttacctccactttcctaccttccatgcggaattcagtgccgatatttccttcttttttaaaaccacagcattatccggagttttcctagaaaatcttggcattaaagacttcattcgactcgaaataagctctccttcagagatcacctttgccatcgatgttgggaatggtcctgtggagcttgtagtccagtctccttctcttctgaatgacaaccaatggcactatgtccgggctgagaggaacctcaaggagacctccctgcaggtggacaaccttccaaggagcaccagggagacgtcggaggagggccattttcgactgcagctgaacagccagttgtttgtagggggaacgtcatccagacagaaaggcttcctaggatgcattcgctccttacacttgaatggacagaaaatggacctggaagagagggcaaaggtcacatctggagtcaggccaggctgccccggccactgcagcagctacggcagcatctgccacaacgggggcaagtgtgtggagaagcacaatggctacctgtgtgattgcaccaattcaccttatgaagggcccttttgcaaaaaagaggtttctgctgtttttgaggctggcacgtcggttacttacatgtttcaagaaccctatcctgtgaccaagaatataagcctctcatcctcagctatttacacagattcagctccatccaaggaaaacattgcacttagctttgtgacaacccaggcacccagtcttttgctctttatcaattcttcttctcaggacttcgtggttgttctgctctgcaagaatggaagcttacaggttcgctatcacctaaacaaggaagaaacccatgtattcaccattgatgcagataactttgctaacagaaggatgcaccacttgaagattaaccgagagggaagagagcttaccattcagatggaccagcaacttcgactcagttataacttctctccggaagtagagttcagggttataaggtcactcaccttgggcaaagtcacagagaatcttggtttggattctgaagttgctaaagcaaatgccatgggttttgctggatgcatgtcttccgtccagtacaaccacatagcaccactgaaggctgccctgcgccatgccactgtcgcgcctgtgactgtccatgggaccttgacggaatccagctgtggcttcatggtggactcagatgtgaatgcagtgaccacggtgcattcttcatcagatccttttgggaagacagatgagcgggaaccactcacaaatgctgttcgaagtgattcggcagtcatcggaggggtgatagcagtggtgatattcatcatcttctgtatcatcggcatcatgacccggttcctctaccagcacaagcagtcacatcgtacgagccagatgaaggagaaggaatatccagaaaatttggacagttccttcagaaatgaaattgacttgcaaaacacagtgagcgagtgtaaacgggaatatttcatctgagaaactgcagggttcctactactcttttttcttgttgttcaattatctcctccccctcttctctcctgtcttttgatttggtcattctctttattttctgcttgccatgtcttttctggaacatacttgcatccaccacagcatcaattcccttgatccagcccaagagaccaggcagccatggccactgccttcctctctgatgaacctatcgggtgaaaacgaccactcaagagactgacttcgccattcaagacaaggaagagacacatgtgtgcactcctgcatgttcagttctgtacttccagtttctaaaatgcactgttcagttttccaaccacttggtggttcaggcttgctttgaacctgagctcttaggcacatgacggtcattcctgacatcctccccagctcaagtctattcttaccatagaacccagggcagggagagaagaacctagaggcctggtttgctttggtggcattgtaaaaagagtaagagaggtttggtttgtggtggtttgctttctttaccataagcaatcccttgccttaactcatcaccctttttcactatgacccttagaccctgagtattttcaaatatatgattgctgatagtagtgaccaaaactactttgttcctttcttaccactctctcctggggccgacacgttgggacagcacaccatagcataaagctaggggatgcatggaaatagcagcttgaaactaggaggtaacaagaaagcttctaggaagtagatgttccatatcttcaaaatgcctcctccaattttgtaagaatgctagctaggtattcctgggattattatactgagatatatatatatacacacacacacacatatgtgtatatatgtatatatatatgtgagtatatatacacacacacacacacacacacatatatatatatacacacacgcacacatatatgttgctgcagcataaagaaattgaaataaaagtttaaa

SEQ ID NO: 1674 - DNA, 4852 bp, Homo sapiens
atgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaatca

SEQ ID NO: 1675 - DNA, 3112 bp, Homo sapiens
agttcagtttgtctctcttgagcttggagaaaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgt

SEQ ID NO: 1676 - DNA, 3018 bp, Homo sapiens
atgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaa

SEQ ID NO: 1677 - DNA, 1417 bp, Homo sapiens
cggtcgcggctgtggccgggggaagtgaatggttttacccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaatt

SEQ ID NO: 1678 - DNA, 1233 bp, Homo sapiens
agagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggagcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaatt

SEQ ID NO: 1679 - DNA, 1356 bp, Homo sapiens
gagcgagggagccgcgggcgagggatcgcaggatgagcgatcggggcccgggcagccggcagcggacgcgccccccgagcccaccggcccgcgccccgcgccccccacggccccgcggtcccggtcccggccgcatcacccacgtcccccgagccccacgggccatgcccggccggccctaagcgcgggccggggggcgtccccttgcgcccgggccccgcgctggcgccccccgggccgccgcccggcgcgggggccatggcgttcaccttcgccgcgttctgctacatgctcaccctggtgctgtgcgcctccctcatcttctttgtcatctggcacatcatagcctttgatgagctgcggaccgacttcaagaaccccatcgaccaggggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacagtatggtttatacgttggtgagtttctaagggggaagccggccagggagcgagcccagaacggaccggacgcctgtgcacccccagccctgccccttggccgcagaggcctcagccctggggagggagggggcactggtgcccccagcctctccaacccccaaactgctgctgcggggaaccccccccaccccgccttcagagccctcccccttggactagagcggctgggcagagctctaaacaggggcaggggctcctctgccagcctgtgggcatggcagtcattcctggaaggggcaggacctccggccttgtccatttcgggggaaacttgggccctgccaaggggcagagcttgaccctggaaattctgggccatccccctccacccccaccctgaggctccccctgcaggtgggggggtacccgcaccgggaatgagcaggctcagcaggggggcagccccacccctagtctgccctcccctctcccccaggctctttctccagccctgtctccatctgccccaacctcagcccaccttgtctcttggacctattttctatgtcgcctggaggagtccggcaccccctccccggccatttgtgacaaaatatgaataaactactgcaaatatgtggg

SEQ ID NO: 1680 - DNA, 2558 bp, Homo sapiens
ccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcccggctacctaaagactccttctctcgggaaagagcgctgcccggctctgggatttgggaggagctcggaggccgctcgggcacctcgctggacactatccgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagctgggagccgagttaaccctgcgtgtctgtgtcaccctgtttgtcaatctttggcattcgaattccacacacggggtcctagagcccttctgagcatcagtggtgtgggggagtaggtgacgaaacactagacctctcctgagagagaattgctgcttcctgaatccacttcattgaacagcaccttgcaagttcaaatgagttcctgggagcggaggctggaaggccacaaggtgcttgctaaggaacagaatgacccagagtcaaggccaagtctgcagggacctgttgaaagcctcgagaatgtcttggctgcccaagactcttgttgcctttcttccaagccatggccatgccctttttctcaaatgggaggggctggagggtgtgtgggatttgtcttcagctgcaaccagccttgagcctgctgggctattttcagctgaggaggggtgaatataggaaaaatgcatttttgaaacgtttgcaacatgatcaaggtgttagttctccaccacacaagttgtattcttcttttgccacctcaaaccatcacagagtctttaaatgcaaatcaattggtcaatgctagtcaaagctatgttcttacaaaaaccccagacagctcagagctcagaaaatcctgtggagtggctgctctgtaccgtgggcatccggcagccaggaagtgagacaacataattataactttgttttatgatgctgcatcatttgtactgtttaggtcgacgtgaggacatcatcttatttagaattttccgtttggcattctcttttgggtgggagttatgctgggggttgtaaataatgacaaggctgagatttttatgatgtttaaattgggcacaatgattttgaccttattccccaaacttcttttcttttctactgtttaacatacacaggctatttatacacgtccccagctcccatctgaaacctgtgactcaggtttatgaatggtgtttgtgtagcaacacattgtgtgctatgtttattaaaatgcagcgacaa

SEQ ID NO: 1681 - DNA, 808 bp, Homo sapiens
gacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacagttatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 1682 - DNA, 3963 bp, Homo sapiens
gtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatggtaggcaaagtgaacttggctctgctggcctctttggggtcacagaaattgctccttgtggtaatcttatatttctgtcaggcacagggccaagaagctgtgtaacagacattactttgcttgcatctctttttcataccttttccctctgaggcagcttttgcttagaaaacagtcccttcactctgcctttcctcctaacttcctgtgcctcttcatgttctgctcaagctttttaaagcaacgaagctgttggagaacttaaatccttgcaactgagagataagctacttaaaggcggtagagatctttttttttttttttttgagatggggtcttgctgtgttgcccaggctggagtgcagtggtgtgatctcagctcactgcaacctctgctttctgggttcaagcgattctcctgcctcagcctcccaagtagctgggattacggctagctactcctggctaatttttgtatttttagtagagatggggtttcaccatgttggccaggctggtctcaaactcctgacctcaaacgatctgcctgccttggtctcccaaagtgctgggattataggtgtgagccactgcgcctggccatgtagatgacttttgaccaaaatgtttcaccttctcattcagatattcttagtaaccaaaacagtgactcatgcagttgagagagcctttgggctgtcagtttacagtacatcaggcttgctgaggctaagcaaatcagaaaggtgccatgtttataacagaggtcaaagctccttacttctgaaacattagctgtggttaaaaacaaaaactcttccttcttgtattgcttgtctatcaaagccaggaaagtgggggatcactgtagttaaattttttttttttttaattagagacagagtcttgccctgtcgcccaagctggagtgcactggcgcaatcgtggtacactgcagccttgaactcctggactcaagcagtcctcctgcctcagcttcccaagtagttgggagtaggtgcacaccaccatgcccagcgaattttttgtagagacagaggtcttgctatgttgcctaggctggtatcaaaattactggcctcaagcgattctcctgcctcggcctcccagatgttgggattactggtgtgagccaccacgcccagctcaaaaacaatttttttaggggcacttctacaaatcatgaaagggggataaaagcactgactttaaaaagccatgtttaagatgctataaatgttctccccttttcattgattggagagttgtagaggaccttagagatcattttgtctaactccctcatcccaaagataaactgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacagttatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 1683 - DNA, 702 bp, Homo sapiens
ctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacagttatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 1684 - DNA, 4125 bp, Homo sapiens
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatggtaggcaaagtgaacttggctctgctggcctctttggggtcacagaaattgctccttgtggtaatcttatatttctgtcaggcacagggccaagaagctgtgtaacagacattactttgcttgcatctctttttcataccttttccctctgaggcagcttttgcttagaaaacagtcccttcactctgcctttcctcctaacttcctgtgcctcttcatgttctgctcaagctttttaaagcaacgaagctgttggagaacttaaatccttgcaactgagagataagctacttaaaggcggtagagatctttttttttttttttttgagatggggtcttgctgtgttgcccaggctggagtgcagtggtgtgatctcagctcactgcaacctctgctttctgggttcaagcgattctcctgcctcagcctcccaagtagctgggattacggctagctactcctggctaatttttgtatttttagtagagatggggtttcaccatgttggccaggctggtctcaaactcctgacctcaaacgatctgcctgccttggtctcccaaagtgctgggattataggtgtgagccactgcgcctggccatgtagatgacttttgaccaaaatgtttcaccttctcattcagatattcttagtaaccaaaacagtgactcatgcagttgagagagcctttgggctgtcagtttacagtacatcaggcttgctgaggctaagcaaatcagaaaggtgccatgtttataacagaggtcaaagctccttacttctgaaacattagctgtggttaaaaacaaaaactcttccttcttgtattgcttgtctatcaaagccaggaaagtgggggatcactgtagttaaattttttttttttttaattagagacagagtcttgccctgtcgcccaagctggagtgcactggcgcaatcgtggtacactgcagccttgaactcctggactcaagcagtcctcctgcctcagcttcccaagtagttgggagtaggtgcacaccaccatgcccagcgaattttttgtagagacagaggtcttgctatgttgcctaggctggtatcaaaattactggcctcaagcgattctcctgcctcggcctcccagatgttgggattactggtgtgagccaccacgcccagctcaaaaacaatttttttaggggcacttctacaaatcatgaaagggggataaaagcactgactttaaaaagccatgtttaagatgctataaatgttctccccttttcattgattggagagttgtagaggaccttagagatcattttgtctaactccctcatcccaaagataaactgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacagttatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 1685 - DNA, 1660 bp, Homo sapiens
agacacactgctaggatactgcctctactcgctgaagcagaatcctctgaagagttgctgaggcagaactgaaatcatggctcacctcaaagaagcagcagtattggccgttaatgatgcctcacacagaaagacgatgctcctttaactcggggttttaatgggaagtttctaagcctgaaacaacagctttagacctggggtgtgccatcagctgccttgcagctaccactgtctactgctttcacacagcgtggtcgggaagaatggaaactaaagaggcttgtaactacctgtaactgttccaccaggaaatggatcaagtgtttgttcagccagagccagtattaaaattagactctatttcctgagcacccacaaatggacctgacaaagggaagacacagatgtactgcgtgatgaggaaagcctatcaggattaaaatatggctataactcagcctctccagagtgcagccaccatgacctccgcagattgatgatggaagaaaagaaaaccaggatatcctgtgctctggcttccctggaccatggatggaggacagcccatcccctcatccctagtgccccttgggaacgaatcagcagattctagcatgtccctggagcagaaaatgacatttgtttttgtgattctgttgtttattttcttgggcattctcattgtccggtgcttccggattcttttggatccatatcgaagcatgccaacctctacctgggctgatggacttgaaggcctggagaaagggcagttcgaccatgcccttgcttaggagggatggtgtgggatctcctcctgaggagatgaagtgctttgtgtcttggtgaggattccctttatttagtgttctcaacaaatcaaatttaaacaatatttggtcccaggaccataatccattattccataaatatgcagttgggttaaagacatttgaggatgttggaaatggacacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctgactaaagaataaaagactagaaaggatctcatatgaatctggtgacaaggccaggaagagatttccttgctctaattatgtctatatttgttttatttcatgggcacctatctgggtcctgagcagaatgaggaagattgtgctgaatggacccaaagtagtttcttgttttctcccaaagcagggagctttgggaagcaatggaaaagcttaaaagagatgattctgtccttggtaaatgtgagtgagaatagcgttttgtttttcaagtaaaacttaattcaaaggctacaaagttttaaaaactatttaccaagccaactacattatatgtattcatattaataacatgtgtagaggtagctatacattacttgaatttacactttacacaaatgatttaaaaaataggttgcaagtgcagcttaaagttttttttcaatgaaaagttaattgtttagaggagaagacttttatagtcttcagaggaatgtgtatttatgattgtatatagtcaccaaataaaacttttcaagaaaca

SEQ ID NO: 1686 - DNA, 1458 bp, Homo sapiens
ggcttaaaaagatgaatcgagatgcagtgtgtaggaagcatgggcaagggatgaggaacgccactttgaaaattactaaaactaaagcaagtgactaagagtgtgaatgaccctggctgcaatgactacgcctgctgggcttctattaaaattagactctatttcctgagcacccacaaatggacctgacaaagggaagacacagatgtactgcgtgatgaggaaagcctatcaggattaaaatatggctataactcagcctctccagagtgcagccaccatgacctccgcagattgatgatggaagaaaagaaaaccaggatatcctgtgctctggcttccctggaccatggatggaggacagcccatcccctcatccctagtgccccttgggaacgaatcagcagattctagcatgtccctggagcagaaaatgacatttgtttttgtgattctgttgtttattttcttgggcattctcattgtccggtgcttccggattcttttggatccatatcgaagcatgccaacctctacctgggctgatggacttgaaggcctggagaaagggcagttcgaccatgcccttgcttaggagggatggtgtgggatctcctcctgaggagatgaagtgctttgtgtcttggtgaggattccctttatttagtgttctcaacaaatcaaatttaaacaatatttggtcccaggaccataatccattattccataaatatgcagttgggttaaagacatttgaggatgttggaaatggacacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctgactaaagaataaaagactagaaaggatctcatatgaatctggtgacaaggccaggaagagatttccttgctctaattatgtctatatttgttttatttcatgggcacctatctgggtcctgagcagaatgaggaagattgtgctgaatggacccaaagtagtttcttgttttctcccaaagcagggagctttgggaagcaatggaaaagcttaaaagagatgattctgtccttggtaaatgtgagtgagaatagcgttttgtttttcaagtaaaacttaattcaaaggctacaaagttttaaaaactatttaccaagccaactacattatatgtattcatattaataacatgtgtagaggtagctatacattacttgaatttacactttacacaaatgatttaaaaaataggttgcaagtgcagcttaaagttttttttcaatgaaaagttaattgtttagaggagaagacttttatagtcttcagaggaatgtgtatttatgattgtatatagtcaccaaataaaacttttcaagaaaca

SEQ ID NO: 1687 - DNA, 231 bp, Homo sapiens
gtgtacaccgactacatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctga

SEQ ID NO: 1688 - DNA, 1618 bp, Homo sapiens
ctttcagataccttctcgaaacaaaagattttcctacctgcttatacttggtaaccgagggaattactaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggca

SEQ ID NO: 1689 - DNA, 2535 bp, Homo sapiens
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcctggggggggccgctcttcccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgccttctcccagagcacaagaaggccagcccactggggcctggggctgccctcggcaaccgtggggaggccatttgctgccctggggcatcatgggcaactcgtgacagcctctgactcaccacgatgatgcctctggacctcggtgatgccttccgacaccactgggaaccaagggccctcgctcaggaaccctggagacagaagtcaggtgtcatcatcagacttgcggccacagcactagagtcacccccccaggcctccagaacctcactggcactgtggcactgccaccagcaatgccctgccttgctgccttcaccctgaacatttactaccctgcaggccaggccagcttcccctcacttaaccaccccacaccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 1690 - DNA, 2457 bp, Homo sapiens
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcagacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcctggggggggccgctcttcccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgccttctcccagagcacaagaaggccagcccactggggcctggggctgccctcggcaaccgtggggaggccatttgctgccctggggcatcatgggcaactcgtgacagcctctgactcaccacgatgatgcctctggacctcggtgatgccttccgacaccactgggaaccaagggccctcgctcaggaaccctggagacagaagtcaggtgtcatcatcagacttgcggccacagcactagagtcacccccccaggcctccagaacctcactggcactgtggcactgccaccagcaatgccctgccttgctgccttcaccctgaacatttactaccctgcaggccaggccagcttcccctcacttaaccaccccacaccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 1691 - DNA, 643 bp, Homo sapiens
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggaggagcctgggactcaggcacagcctgggagagcacaccgtggtgggacatga

SEQ ID NO: 1692 - DNA, 2577 bp, Homo sapiens
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcctggggggggccgctcttcccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgccttctcccagagcacaagaaggccagcccactggggcctggggctgccctcggcaaccgtggggaggccatttgctgccctggggcatcatgggcaactcgtgacagcctctgactcaccacgatgatgcctctggacctcggtgatgccttccgacaccactgggaaccaagggccctcgctcaggaaccctggagacagaagtcaggtgtcatcatcagacttgcggccacagcactagagtcacccccccaggcctccagaacctcactggcactgtggcactgccaccagcaatgccctgccttgctgccttcaccctgaacatttactaccctgcaggccaggccagcttcccctcacttaaccaccccacaccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 1693 - DNA, 1577 bp, Homo sapiens
agattttcctacctgcttatacttggtaaccgagggaattactaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggaacgaggggtccctgagggaaaggactggggctccttcatctctgtgatcctagtgcagtgtctgaaggcatcaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcct

SEQ ID NO: 1694 - DNA, 2664 bp, Homo sapiens
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggccaggctgcacccattggggtgaccaggcagatggagccctggaggtgggggctccatggagtggtgccccatttcaggttcgaaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcctggggggggccgctcttcccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgccttctcccagagcacaagaaggccagcccactggggcctggggctgccctcggcaaccgtggggaggccatttgctgccctggggcatcatgggcaactcgtgacagcctctgactcaccacgatgatgcctctggacctcggtgatgccttccgacaccactgggaaccaagggccctcgctcaggaaccctggagacagaagtcaggtgtcatcatcagacttgcggccacagcactagagtcacccccccaggcctccagaacctcactggcactgtggcactgccaccagcaatgccctgccttgctgccttcaccctgaacatttactaccctgcaggccaggccagcttcccctcacttaaccaccccacaccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 1695 - DNA, 6033 bp, Homo sapiens
ggcgcaacgggcggcggaagtaggagcctgggaaggaagagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgaccccgcagaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaagttttggtttcttaaatgggaaaggagtagttactgaattgggatatggttttcctggtcattctggaccttttgaaagttttcccacaactatagttctataacagtgatactgattttttagagttcaatatggtccttatattatttttttccagtgtatatgctaatggctaatcatgggagccaaaactaaagaaaagcaggaatggacaaccttcaaaggtgttaataataactaggcagtatagcagaatggctatgaaccagaatccttcctgattctaccacttattagctatacagctgtggaagtaaatctaatacagtttgtgaggatgtactgagtattgcatatagcaggtacacgtacagtgtataagacagtgcttcagacctggtacatgctcttatattggtagttactgttagtagtagtagaggcttatttggaaactatcttagtccattttctgttgctatgggagaatacccaagaccaggtaatttataagaaaagtttgtttggctcacagttctggagtttatttgccagcagcttctggcaagggttttcatactgcatcaaaacataatagggtgtaaaaaatagaaggacaaacaagtgtgggcaaacttttataacagcccgctctcttgagaactaatacctgtaataatggcataaatccattcacgagggctccagcctcatcaccctattacctcttaaaggctccatttcttagtcctgttaaattagcaactaagtttccaacacatgaactcttgggggacacatcaaaccatagcagaaccatagataaggagatacctacttatatgaattaattttacttacatctttgatgtagaattttctaaaacataatgttcttaacctgataacttgttagtcctttaatctttcattttgaaaagttatatttctaagtgaattaccattctgtaacatagtaatggactcaggaagtagtataaaaaatttatgtcccaatttaataatttgagcttttatattaaaagttattttttccccatgagctgttaactcttccacagccattgtaactagtttcaagataagtaaattttacgtatattttcacagtcctcattaaaatcacaaatagaaattactacccactaagacaaggtttaactttccctaatcccatgcaatagatctgagagatttttttttaagaaagaatttaaataggacactaaagaatcaattcaagttccacactttactcttgagtgaaccactcaaaaaactattttacttttatttgaaatacaaagaaaccacattttcccaggccacagatcaaaaggagggagattactagagcagacaaaagcaaagcaaatatagaaatctagagaccacacagcataggggcaaacatgcccatatttccacattgacctttggtattggtgcatttcctagagcacaggaagttaactgtttttagagataaatgaaaatggaagagttactttaagaagctagtgaaatatacaatctattttatagctttgattaaaatcagaagtagcccacttcatgtagaaaattcacttatgtacatgttgctttccccatagaagccagattagattacacagtataaataatatgttcatcctccttatgtcaaagactaaaccattcattgtagccttcagaatacccatgtgtatccatactgaagatttttttcacctggtacatctgtctcagttgtgtcttgcttgcttatgggtgcctctgttgatattattccctgttaatatgtggtaacccacaggttttttaccccttaagatacaccttctccaagtagcctttctgaattaagatcagtactttgttgtcacatgattcagctcttcaagtctgaattttcccatttattttggttttctaatgtttcacataggcatgttcctgcttttaagaattcagttccattttggcagcaactcagtaagtcttacagatgtaaattttactttagctaataagggagcaagaggaaggaataggtggctttttgttatgttttcttcattctgtcgatttatggatgtactgaattgaaccttataaaaagaaatctaaagattccaaaggaagctctttagagcaagtttcagctagtatgaaagaagtcaacataaaatattcaattttaaatagattcataagctacagatgggccactgttttttggttgtttgaattttacctagaacagagatatcaagtgtagatttaaaagcttctagctgggtaaaaaatttttggctaatctttccttactaaagaaccttatacatcatttgtctaacactttaaactgtcacagtcactgactttttagtatacctgtttgatagctatcatcactgtactgtttaaatggaaaataattttctccactcaaaagctggtttaacaaatgtctattgtatgaatcatattaacaaccaacaattagtactagattttgagatctataggcaaggacaatatttcacatccacttcaatttcaaacaaaaatatttattttaattaaacaatttcttggtattgttcaaaacattaatcaagcaattatctcataagactttttttctttacaaaggaaaatttccaattttggttttaaaaaaggcaaaccagtaagctacattagagatcagatataatatacagcctatgcagccacatgagaaatagtttttgctgctttgttattacacaggtagttgcttccttcagctaaagcctggagtattgtatttcttttatgcatattgggtttggttctattacttggcaggagattgtactcccctgagtcagctgtgttcattggtcagaataaattccagcatctgacaccaattccattaatcacagacaagcttgaataagtgtaagataatagaaaaaaatatctagtgaatggcgaacattgtctatgtatgtatgctattcagtaatacagtagaagagatctgagatattgagttcaagatatatgaaactgtctatcaaaaaggataaaagtcctcctacatgaaatactttaattcaggcaaaaggtgtatgaaccaagtaaatctccaccctgaaagaacttaaatttccatgtgaagccatctttatttccttctttatttccaaataattggccacttagaataagtgtggacatttcatgatcgacaatatcaatacagcccaaaccctgatttctatgattaaaaataataattttaaatcactttctcaataaatagaatattacatttcaacacaaagtctaacaatttagaagctgctctacacaatgtgcagctagctgtagtctctttgaagaaaatgactttttatcattacacacatttatgtttatattatggcccacagaagggcagattagactgaaatctgtgtgatgctccttctactacttattgaatagtgtgtagggttacaatcatttgtttacaccccagagtttttcaactatttcatttttttttttttttttcccaattaggacttaaggaatgtgctgggacaaagttggcttcagtgatcaggttgtttcaagtcttagaattcaaacttcaattctaaaaaaattttatcaacaaaacactgtgaccaaaaaatcactttaaatcttaaatattgaaacgcaatagcatataaagatggtataacctaagatgcttttatttcattatattttcaatatctttacgcattataacaacagaaatgtaacctactcacattgccatttgttccattatgcaatttgaagaaacatgttttccttttatttttatgaacagatatttagacatttcacattttgtaaaaccacgtctacaatctccaattccattcttctgagaggcaaaattttacaattaatatagaaggcagagttttttaaacaccttaagtttacttattaattagtatagtagcatatttcagattcttagaatatggagctagagggtgctctttcatactagaaaaccaactatgttggtttttgtactattgtacagtgtgttcaaatatagatactgaagacctctgcaaaattttaatcaaaatctcctttcagtttgttaaataatttcttgggaggaccactgaaagagataagtgtcctcatggtgaaatcgtgaatctcttccaaattaattcttataaaggcagttctgattatgttgatccaagtaatgcagtggtggaaggttgggtaaaggcaaagttttagttttagtttccccaaatgctgtctcacttgatttaggaggacttggaaatacccaggaattgtcttccagagaatttctgccataagaactgtgttcctgaaagcatgtaccatcattaggaatggatctctcattgtctgtccatgattggaggattgctttctctgataaaacctttacatctcctggtaaaggggaagatgtggtatgacaaagagctttgccatttggtaagagagggggatgtcttgtgtatgttgcagtaaaattcatcaagtgcagttttgtgctgtctcttccaaggtcttcactgcatcctacaggggcacaggctaaaaagaaaacacagactaaatgtcagttttcattacatttgtgatcataaaattcgataacacttcaccaatttgaattctagaactggtgatgaaattaagatttccaagttagtgtgatcattgaggcactgtgactaggagataaatgacagatgatctgagttttaatcctggatcagcaatttactgtgactttagatatttgtctcttagctgctcctgatgtctctttccttgtctgcagaatggatatagaattcctgtcccaactatgtcatagagcttttaaaagatgaagaactacatatttttaaaagttggaaactaatacagttaaaatacaaataaagatcctgttcttggctcttattgtggctggagaaggattgcagactgttcacatgtcagtggggactgagacagttcttaagttttagcattttttagttaaatataatattcctttgctcaaactctttgtccacaggcagtccaaaagcaaattttttagaaataattgcatttttaattggtgagacccaaatgaagtttttatatatcaaaggcttttatggataaagcagtttaaataaaatttgtgaaatcttgtttcttgtaaaacacagcaaatgttaatgctactgtggtcacaatgtaggtaaagtaaaaaaaaaaaaaaaaa

SEQ ID NO: 1696 - DNA, 1413 bp, Homo sapiens
attcactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatattattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattagggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgttcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccagga

SEQ ID NO: 1697 - DNA, 3128 bp, Homo sapiens
gttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccagaccaggcacagtggctcatgcctgtaatcccagcactttgggaggtcgaggtgggtggatcacctgaggtctggagtttgagaccagcctggccaacatggtgaaaccctgtctgtactaaaataacaaaaaaattagctgggcttagtggcaggtgcctgtaatcccagctacttgggaggctgaggcaggagaatcgcttgaacctggaatacagaggtttcagtgagctgagatcaccccattgcactccagcctggacaacaagagtgaaacgctatcaaagaaaaaaaaaagatgtaatccagatatatttgacagtaattaaaatcttttaaatgttataaatgcagtatgtttgtgaaagtattagaatagaaccaaagtgcctgtctctgtttataaagttacagtttgttagagctaccagaactttggagaatagggttagctactgaatgatggcaagttaaactaaacaatactgcatattactgttttgtaaaataagaggatcagtgagatgattcatgttttttttttttgagatggagtctcactgtgtcacccaggctggagtgcagtggcgcaatctcagctcactgcaacctccatctcccggattccagtgattttcctgcctcagcctccaagtatctgggattgcaggtgcacaccaccacgcccagctaatttttgtatttttagtagagatggggtttcaccatgttggacaggctggtctggaactgctgacctcaactaatccaccctccttggcctcccatagtgctgggattacaggcatgagccacctcacccagcattttttttttttaatttttttaatgagacagagtctctctctgtcacctaggctggagtgcagtggcacgatctcggctcactgcaacctctgcctcccgtgttcaagcaattctcctacctcagcctactgggtagctgggactacaggggtgcaccaccatgcccagctaagttttgtatttttagtagagatgggatttcaccatgttggctaggctggtcttgaactcctggcctcaagtgatctgcccaccttggcctcccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagtgaaattca

SEQ ID NO: 1698 - DNA, 1086 bp, Homo sapiens
tggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaagcaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtca

SEQ ID NO: 1699 - DNA, 2588 bp, Homo sapiens
agtgttactgcggtgaccgccagagcagcctcgacgctatggaggagcctggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgaacaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggagaagtgagtgaacttaataaacagaaaataacatttgaagactccaaagtgcacgcagaacaagttctgaatgataaagaaaatcacatcaagaccctgactggacacttgccaatgatgaaagatcaggctgctgtgcttgaagaagacacaacggatgatgataacctggaattagaagtgaacagtcaatgggaaaatggtgctaacttagatgatcctctgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagcatctttgcaatcagaaaacatatattttgaaagtgagaatcagaagcttcaacagaaacttaaaataatgactgaattctatcaagaaaatgaaatgaaactctacaggaaattaacagtggaggaaaattaccgaatagaggaagaagagaagctttctagagtggaagaaaagatcagccgtgccactgaagggctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaacagagttgaaatttgaacttttagaaaaagatcctaatgcactcgatgtttcaaatacagcatttggcagagagcattccccatgtagtccctcaccattgggtcggccttcatctgaaacgagagcttttccctctcctcaaactttgttggaggatccactcagactctcacctgtgcttccagggggaggaggaagaggcccaagcagcccagggaatcccctggaccatcagattaccaatgaaagaggagaaccaagctatgacaggttaatcgatcctcacagggctccttctgacactgggtccctgtcatctccggtggaacaggaccgtaggatgatgtttcctccaccagggcaatcatatcctgattcaactcttcctccacaaagggaagacagattttattctaattctgaaagactgtctggaccagcagaacccagaagttttaaaatgacttctttggataaaatggataggtcaatgccttcagaaatggaatccagtagaaatgatgccaaagatgatcttggtaatttaaatgtgcctgattcatctctccctgctgaaaatgaagcaactggccctggccttattcctccacctcttgctccaatcagcggtccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctatccaccgaggggtttacctccttaccttcatccgagacctggattttaccccaaccccacattctgaaggtagaagcgagttcccttcaggattgattccgccttcaaaggagcctgctactggacatccagaaccacagcaagaaacctgacaatattgttgctttcttcaaaagtaattttgactgatctcattttcagtttaagtaactgctgttacttaagtgattgcacttttctcaaattgaagtttaatggaataatagttctcaggatagtattt

SEQ ID NO: 1700 - DNA, 2588 bp, Homo sapiens
agtgttactgcggtgaccgccagagcagcctcgacgctatggaggagcctggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgaacaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggacaagtgagtgaacttaataaacagaaaataacatttgaagactccaaagtgcacgcagaacaagttctgaatgataaagaaaatcacatcaagaccctgactggacacttgccaatgatgaaagatcaggctgctgtgcttgaagaagacacaacggatgatgataacctggaattagaagtgaacagtcaatgggaaaatggtgctaacttagatgatcctctgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagcatctttgcaatcagaaaacatatattttgaaagtgagaatcagaagcttcaacagaaacttaaaataatgactgaattctatcaagaaaatgaaatgaaactctacaggaaattaacagtggaggaaaattaccgaatagaggaagaagagaagctttctagagtggaagaaaagatcagccgtgccactgaagggctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaacagagttgaaatttgaacttttagaaaaagatcctaatgcactcgatgtttcaaatacagcatttggcagagagcattccccatgtagtccctcaccattgggtcggccttcatctgaaacgagagcttttccctctcctcaaactttgttggaggatccactcagactctcacctgtgcttccagggggaggaggaagaggcccaagcagcccagggaatcccctggaccatcagattaccaatgaaagaggagaaccaagctatgacaggttaatcgatcctcacagggctccttctgacactgggtccctgtcatctccggtggaacaggaccgtaggatgatgtttcctccaccagggcaatcatatcctgattcaactcttcctccacaaagggaagacagattttattctaattctgaaagactgtctggaccagcagaacccagaagttttaaaatgacttctttggataaaatggataggtcaatgccttcagaaatggaatccagtagaaatgatgccaaagatgatcttggtaatttaaatgtgcctgattcatctctccctgctgaaaatgaagcaactggccctggctttattcctccacctcttgctccagtcagaggaccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctatccaccgaggggtttacctccttaccttcatccgagacctggattttaccccaaccccacattctgaaggtagaagcgagttcccttcaggattgattccgccttcaaaggagcctgctactggacatccagaaccacagcaagaaacctgacaatattgttgctttcttcaaaagtaattttgactgatctcattttcagtttaagtaactgctgttacttaagtgattgcacttttctcaaattgaagtttaatggaataatagttctcaggatagtattt

SEQ ID NO: 1701 - DNA, 2626 bp, Homo sapiens
ttgttgtggccagtgttactgcggtgaccgccagagcagcctcgacgctatggaggagcctggtgctacccctcagccctacctggggctggtcctggaggagctaggcagagttgtggcagcactacctgagagtatgagaccagatgagaatccttatggttttccatcggaactggtggtatgtgcagctgttattggattttttgttgttctcctttttttgtggagaagttttagatcggttaggagtcggctttatgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgagcaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggacaagtgagtgaacttaataaacagaaaataacatttgaagactccaaagtacacgcagaacaagttctgaatgataaagaaaatcacatcaagaccctgactggacacttgccaatgatgaaagatcaggctgctgtgcttgaagaagacacaacggatgatgataacctggaattaaaagtgaacagtcaatgggaaaatggtgctaacttagatgatcctccgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagcatctttgcaatcagaaaacatatattttgaaagtgagaatcagaagcttcaacagaaacttaaaataatgactgaattctatcaagaaaatgaaatgaaactctacaggaaattaacagtggaggaaaattaccgaatagaggaagaagagaagctttctagagtggaagaaaagatcagccatgccactgaagagctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaagagagttgaaatttgaacttttagaaaaagatcctaatgcactcgatgtttcaaatacagcatttggcagagagcattccccatgtagtccctcaccattgggtcggccttcatctgaaacgagagcttttccctctcctcaaactttgttggaggatccactcagactctcacctgtgcttccagggggaggaggaagaggcccaagcagcccagggaatcccctggaccatcagattaccaatgaaagaggagaaccaagctatgacaggttaatcgatcctcacagggctccttctgacactgggtccctgtcatctccggtggaacaggaccgtaggatgatgtttcctccaccagggcaatcatatcctgattcaactcttcctccacaaagggaagacagattttattctaattctgaaagactgtctggaccagcagaacccagaagttttaaaatgacttctttggataaaatggataggtcaatgccttcagaaatggaatccagtagaaatgatgccaaagatgatcttggtaatttaaatgtgcctgattcatctctccctgctgaaaatgaagcaactggccctggccttattcctccacctcttgctccaatcagcggtccattgtttccagtggatacaaggggcccattcatgagaagaggacctcctttccccccacctcctccaggaaccatgtttggagcttctcgaggttattttccaccaagggatttcccaggtccaccacatgctccatttgcaatgagaaacatctatccaccgaggggtttacctccttaccttcatccgagacctggattttaccccaaccccacattctgaaggtagaagcgagttcccttcaggattgattccgccttcaaaggagcctgctactggacatccagaaccacagcaagacacctgacaatattgttgctttcttcaaaagtaattttgactgatctcattttcagtttaagtaactgctgttacttaagtgattgcacttttctcaaattgaagtttaatggaataatagttctcaggatagtattttgtaaataaagatggtttgaatatgaa

SEQ ID NO: 1702 - DNA, 1797 bp, Homo sapiens
aaatggcgcctgtcagagtgggaaacccagctgcagaggctgcagccccggtccccagcggctaaaggacccccgagctcggggagggggaggccgctccggcccagcgctctgcgccctccggctccccctccccctccttccctgctccttcgctctgcaggtctcggaggaccccatcctagccctacctgtctcggcccgcaacctccccgaagccgtcggtgccactcccagcccatgtgggcccccgcgggctgcccacgcctgtcccccagctccccgttccgctgggctttaccctcgccaggggtggctttctgagccgcccgctccgtgcccctctctgcagcctctcctgccactcggggcccccgttccccctcccggcggcggggggctgcccccggggggctggcggagctgggccgcgggggccccggggccggcggtgccggggtcatcgggatgatgcggacgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactccacttggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccagctttgtgtcttttttccttttctctcttttaaaccatgcattataactttgaaaccaaa

SEQ ID NO: 1703 - DNA, 1708 bp, Homo sapiens
tttcccttcctcccttttccctagccccctcccccactgccccctcccccaattatccttccccttccctccaggtctcggaggaccccatcctagccctacctgtctcggcccgcaacctccccgaagccgtcggtgccactcccagcccatgtgggcccccgcgggctgcccacgcctgtcccccagctccccgttccgctgggctttaccctcgccaggggtggctttctgagccgcccgctccgtgcccctctctgcagcctctcctgccactcggggcccccgttccccctcccggcggcggggggctgcccccggggggctggcggagctgggccgcgggggccccggggccggcggtgccggggtcatcgggatgatgcggacgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactccacttggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccagctttgtgtcttttttccttttctctcttttaaaccatgcattataactttgaaaccaaa

SEQ ID NO: 1704 - DNA, 952 bp, Homo sapiens
ctatgaagaagcttcctggaaaacaataagcaaaggaaaacaaatgtgtcccatctcacatggttctaccctactaaagacaggaagatcataaactgacagatactgaaattgtaaagttggaaactacattttgcaaagtcattgaactctgagctcagttgcagtactcgggaagccatgcaggatgaagatggatacatcaccttaaatattaaaactcggaaaccagctctcatctccgttggctctgcatcctcctcctggtggcgtgtgatggctttgattctgctgatcctgtgcgtggggatggttgtcgggctggtggctctggggatttggtctgtcatgcagcgcaattacctacaaggtgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatcagtagctgaaaa

SEQ ID NO: 1705 - DNA, 869 bp, Homo sapiens
gtccatgtatctctgagcagctatgaagaagcttcctggaaaacaataagcaaaggaaaacaaatgtgtcccatctcacatggttctaccctactaaagacaggaagatcataaactgacagatactgaaattgtaaagttggaaactacattttgcaaagtcattgaactctgagctcagttgcagtactcgggaagccatgcaggatgaagatggatacatcaccttaaatattaaaactcggaaaccagctctcatctccgctgtcatgcagcgcaattacctacaaggtgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatcagtagctg

SEQ ID NO: 1706 - DNA, 417 bp, Homo sapiens
cataaatgcagcccctgtgacacaaactggagatattatggagatagctgctatgggttcttcaggcacaacttaacatgggaagagagtaagcagtactgcactgacatgaatgctactctcctgaagattgacagcaaggaagagaaacttttcttaacatctttcaggattctgaccattgtgtttatttgggtcggattatctcgccagaagtcgaatgaggtctggaagtgggaggatggctcggttatctcagattccctcttctctcagtccaattttcaaaatggaaaaggaaatatgaattgtgcttattttcataatgggaaaatgcaccctaccttctgtgagaacaaacattatttaatgtgtgagaggaaggctggcatgaccaaggtggaccaactaccttaa

SEQ ID NO: 1707 - DNA, 3054 bp, Homo sapiens
gagatggttcaactctcttacttggttatttccatctcggttattccttgctccagcagaatcctgaaatgtccatgtatctctgagcagctatgaagaagcttcctggaaaacaataagcaaaggaaaacaaatgtgtcccatctcacatggttctaccctactaaagacaggaagatcataaactgacagatactgaaattgtaaagttggaaactacattttgcaaagtcattgaactctgagctcagttgcagtactcgggaagccatgcaggatgaagatggatacatcaccttaaatattaaaactcggaaaccagctctcatctccgctgtcatgcagcgcaattacctacaaggtgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatcagtagctgaaaattgcttatttctccctttcttctcactggagttatttttaatattatctttcctatcagaattacctagtcccttctttgaatatacagaagccatcacgtgagtttatcatttgcttcccaattgttctattttcctttaattttctttcttcttgtccttcatttctaattacctgaacatggtatgatttactgcatcttcagatatacacatataacatcaaaatcaggccaatataggttagggcttaattaatataagttgtgcaaaatatctatgtttgaaatctgtccaaaatatctaagtttgaaaggcggtgtaagatagtaaaaagaatattaaacttagaatcagcaaaataatttagatgtcaattaactaaattacaatcatgaacaagtttcataacctctttaacttcccttttctcatatttaaaataggaataataacaaccatcttttatatctcacagttctacaacctaaaatagaactttagagtgttaactgtaccagaaactccatgaaagcgaacactatgacttccccattcactattctcttaccagcaccaacccgaaaccctggctcacaaaacagagagatatttgtttctctttgtataagatagttcatgagaaaaatagctcaatcattaaaacattacgcaaatagaattactattccaagtctacctctggttagattcaacagtagtaattttctgcgctagagaaggaaaagaaagtttgcaagaaaactcactgggtttgtaaaatgaataaatgcttcttaagtttcagaggctactagacagaaggacaagtaaaaatgctttaattagtattttcctaacagttctgtgctttatttttgctgagtaactcaggaagtatttacagaatatgtggaaaggcacccttttacaggataataggaaaaaattgcatttctttcccacagcttcccttttttaactagtggctaccatttacgaacatgattctcaaacatctcaacggaggttttggttaaaacatagagaaaccaaataggaaactcaaatgctgatgttactcagtgggaagactgaggagacacagagacctgggtttttaccagcatcacgacacaattctcatacaagtagtctttaatacagttagagaaatatcactactttagaacttactctctatctggctttggataagtaatgttctcaccttgaaatgggtttaatattattaccttgctcataagttaattgtgaagctcatttaatatgattatataaagtatcgatcagaataccaagtatgtaatacatactcaataaatatgtgttactcttaaagctttgtgcgctaacactgaaagacacttgaatctttatcttttttctagcctatcaataattaagcagatttggagggcttaggaaaaataatagaaatacctcaaattttacttgttacttcaaatgtctggagatcttggatttgggtgatggtatcagtatgttttttattttgaattgtctatttagagaaactaaataggaaccaataattcagaaaactgtacaaaattagcaactcaactttgtttcatctccctaaaatggaaaaacatatgtgtatacatccctatagcacacataaacttagaagaataatatcttagtgcatggcaacaatacaattaaaaatgtaggccaatcactgtgattctttttctggtattcatatctaaagtatcttatacataaaatcaaaatagcacaaacgttagtagcacagatcagaccacctcatttcaaatactaaatcttctacatgtcatctaagtgaactccagcaaaatttgacttctgtcttcttcaatttaaaactaacttacaggcatgcctcggaaatattgtgggttcagttccagaccaccacaataaagcaattattgcaataaagtgagtcacattaattatttgctttcccaattcgtgtaaaagttatgtttgagctacaacgtcttctattaagtatacaacagcattatgtctggaaaatgtacatagttttattaaaaatagtttattgctaaaaa

SEQ ID NO: 1708 - DNA, 1097 bp, Homo sapiens
agtagagtgtgtctgggtcagctgagtgactacatcaaagctcccagccttgaaaaacacatgctgttcccaggcctcaagatattgaaacattaattagataatttaaagtagcgttttcttctacaatgtctgaagaagtgacctacgcgacactcacatttcaggattctgctggagcaaggaataaccgagatggaaataacctaagaaaaagagggcatccagctccatctcccatttggcgtcatgctgctctgggtctggtaactctttgcctgatgttgctgattgggctggtgacattggggatgatgtttttgcagatatctaatgacattaactcagattcagagaaattgagtcaacttcagaaaaccatccaacagcagcaggataacttatcccagcaactgggcaactccaacaacttgtccatggaggaggaatttctcaagtcacagatctccagtgtactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttggctgggattatcatgggactcctctggcagaagttggttctgggaagatggctctgttccctctccatccttatttagtactaaagaacttgaccagatcaatggatccaaaggatgtgcttattttcaaaaaggaaatatttatatttctcgctgtagtgctgaaattttttggatttgcgagaagacagctgccccagtgaagactgaggatttggattagtatgcttcttccaaattctccaagaagtaagagacttgtgagtaagctcatatgaggaaagaggaaactacggtaccagagccaaaccagcttttaaaatgactgtgtatttacattatcagacaaatgaacttgttt

SEQ ID NO: 1709 - DNA, 3029 bp, Homo sapiens
agtagagtgtgtctgggtcagctgagtgactacatcaaagctcccagccttgaaaaacacatgctgttcccaggcctcaagatattgaaacattaattagataatttaaagtagcgttttcttctacaatgtctgaagaagtgacctacgcgacactcacatttcaggattctgctggagcaaggaataaccgagatggaaataacctaagaaaaagagggcatccagctccatctcccatttggcgtcatgctgctctgggtctggtaactctttgcctgatgttgctgattgggctggtgacattggggatgatgtttttgcagatatctaatgacattaactcagattcagagaaattgagtcaacttcagaaaaccatccaacagcagcaggataacttatcccagcaactgggcaactccaacaacttgtccatggaggaggaatttctcaagtcacagatctccagtgtactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttggctgggattatcatgggactcctctggcagaagttggttctgggaagatggctctgttccctctccatccttgtacgtctctaactattgagggtaaacacaagctttccatggaatcctgggaaaattaataatgattgtgagaattataaatacagacataaaaagaggagtacaacatactgagaaaagagctccagtaacaaatattgaaaggaggtatagttcatttcatctctgtgacaaatttatagcaaggcactgaattttatcttttggtagaaatgtgtttatttaacacacacacacacctaatactacattcaaagtattttataaatactaacccttgaagaaagcagttatattcccattttataggtagaaatattataatagagagattaagtaacttgcctgaggtcactcagctcataaattgcactttagggattgtgcactcagtcactcagctattctgactctccagcacctacaatccaaaagggtgctgctggtcataagaacacatatcaacacatttatttatactaaataactgtcaaccattttctaacaaaaagtaagactgaattgactgattagttcaacaattagtgtcatgttgaggacttgccaattacaatatacggcaagtgtcttttatgaattaaaatgaactaaaccttccacttcagggtttggatgaaactatttaaaggacaaatagaatatataacacttggaaaatttcaatttttttaactatttaaagttatgaaaaaatagacgtcaacaaaaatgtgtaaggggatattaggtttgctaaattctttcacagactataaaacaaaaaattttgaggaacacctctcatcataactacatttaaatgaaacaactgtattaatattttaaatataatagtatttttctattagataaaatttaagatctttggcatcttaatggatttttaaactttttattgatacataagagatgtatatgttttggggtatatgtgataatttgatacattcagatagtgtgtaaagatcaaataagtggaattgggatatcgatcactttaaatatttatcttttctttatgctaggagcattcaaattattattttctcattattgtgaaatgtacagtagattattgttaattgtattcaccctaataatctatgaaacactaggtcttacttcttctatctaacagaatatttgtattcataatggctttttatctaccttcctcccccaacaaatcattatccacccccctccctcctgtttcactctttaaagcatgttgtcaacgttttcttaaactgaataataatcactcatcttctgtcaaagatgccatgcttcagctgtgactcagcagttccttaaatcacaaacaatggtaggtctattattttctccctggatacactttatcttcatccatttcccaatgttttgtcatggctatttctactcaaacactaatcccccattctctaatcaccattattaatcatatcaagtcaattagtttggtttcacactaataataatgacaaaaagcacatgcagagtaatacacaaacaaaaaaagtgacagttacttttttgtgacaagagcaatattgggtatgaactgattaatattaatctgaggtgttgctactagactgagggtttccaggagtagtactatgacatcatgtaaacacattcagttttcatgttggaatctaagatgtgtcccttctcccaaagggattttaatcattcttggcctctctactcactcttaatcaaagtgtggaggaggtggcccccacagcagggtttggaacctacagaccctggcccctgagacatgcagctgtcagacaagccagcatgtcaaacacaggttagagagactgagcttccagattgcatagccatttccttgactactgagtaaaggccaaggctaagatttagtaagcctagccctgaagcaagcaaagaatatggcagtgtaatgcaggtcatttagaaaaaaacaatgttgggcacaaagaaaatttagatctgacaagtataattttctaaagacattatttcaggattaacatcaatttcttagcagaggaaatgaatactattgtcagaaccatatctatatagtcaatcatttcctcttttaacgtctgtcttgttctctttttacccaccacatatgtataactatgtgaaaaattatatttgtgcataataaaatgtgataactttttacaac

SEQ ID NO: 1710 - DNA, 2267 bp, Homo sapiens
ctcctcttgctctaagcagggtgtttgaccttctagtcgactgcgtcccctgtacccggcgccagctgtgttcctgaccccagaataactcagggctgcaccgggcctggcagcgctccgcacacatttcctgtcgcggcctaagggaaactgttggccgctgggcccgcggggggattcttggcagttggggggtccgtcgggagcgagggcggaggggaagggagggggaaccgggttggggaagccagctgtagagggcggtgaccgcgctccagacacagctctgcgtcctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccagggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgctcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagtgatcctgagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgataacccag

SEQ ID NO: 1711 - DNA, 630 bp, Homo sapiens
gggacaaactctcgggcgatgtgttgtgtccctcccgggaggtacctccgtgctggcaaatgcgcagagctccctaactgcctagacgacttgggaggctttgcctgcgaatgtgctacgggcttcgagctggggaaggacggccgctcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagt

SEQ ID NO: 1712 - DNA, 1996 bp, Homo sapiens
agacgcctgagtcggagagacagggggcagaggttgccaagccctggctgccacttgtcaggttccctgtgctagacatgcataatctgtattccatcactgggtacccggacccaccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccagccctcaccctgagcttctcttctccaggttcaagtgctccaccaagacctccaagggcagcaaaggaaacagagaaacccccacttccttgcaagccccggaacatgacaggcctggacctcgccgctgtcacctgtccacctcctcaactggctgtgaatcttgagccttctccattgcagccatccctggccgcaactccagtcccctggctcaatcagaggtctggaggtcctggctgctgccagaagaggtggatggtgtacctgtgtctgctggtggtgacttccctgttcctgggctgccttggtctcactgtgaccctgattaagtaccaggagttgatggaagaactgagaatgttaagctttcagcagatgacgtggcgaacaaatatgactggcatggcagggctagctggcctgaagcatgacattgcccgtgtaagagctgacaccaaccagtccctggtggaactttggggcttattagactgccgccgaattacctgtcctgaaggctggctgccctttgagggcaagtgttactacttctccccaagcaccaagtcatgggatgaggcccggatgttctgccaggagaattactctcacttggtcatcatcaatagctttgctgagcaccttctgggagccagaggaacccaataacatccacgatgaggactgtgctaccatgaacaaaggtggcacctggaatgatctctcttgctacaaaactacgtattggatttgtgagcggaaatgttcctgttgaagcccagggccgaggctgggggtccatatctgagtgtctctttgagatgagaatctcctgccctttcgtggacggccttgcctcttcgtgagtggacacacagatgtgcctcaaacaggattggcaccctggatgcagcaagttcccaggggtgcaagtcaggctgtttctagagtgaggacttgggcttgccctagtagatggtgagctgggaggatgctcagagcttggtggtgggaggtctcccacttctggggttgaaaggatcttcactaagttcctgatcatgactcttgggaagtgatactagccctgaggaccctggggctggtgttgaacctgggatgaaatatcctggcgcctgtgaaccacaaagagctgggactgggctccttttcctgcagcctcaaacttctgggctcaggtgatcctcccatctcagcctcctgagtagctgggactacacatgcgcaccaccatgcctggccaattttttgtagcatttaaagagagggagtctcactatgttgcccaggccagtctcaaactccttgcctcaatggatcctcctacttgggcttcccaaattgtgaggattacaggtgtgagccactgtgcctggctcaaaattattattattatttttatagagatgaggtctcactctgttgccgaggctggtctcaaactcctggggtcaagcaatccttccgtgatggcctcccaaagtgctgggattacaggcatgtgtcaccgtacctggccgatatttttatttttatttttactttccccatcttttccttttttttttttttccaaacaaaagctttgaaagtggtgacagaaaaatttccctttgagctagacctctagatctgcctcgcacagaaatacattaagtgggctggtctcatgtagtccccacatcattgcaaattac

SEQ ID NO: 1713 - DNA, 1399 bp, Homo sapiens
agccctggctgccacttgtcaggttccctgtgctagacatgcataatctgtattccatcactgggtacccggacccaccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccaggttcaagtgctccaccaagacctccaagggcagcaaaggaaacagagaaacccccacttccttgcaagccccggaacatgacaggcctggacctcgccgctgtcacctgtccacctcctcaactggctgtgaatcttgagccttctccattgcagccatccctggccgcaactccagtcccctggctcaatcagaggtctggaggtcctggctgctgccagaagaggtggatggtgtacctgtgtctgctggtggtgacttccctgttcctgggctgccttggtctcactgtgaccctgattaagtaccaggagttgatggaagaactgagaatgttaagctttcagcagatgacgtggcgaacaaatatgactggcatggcagggctagctggcctgaagcatgacattgcccgtgtaagagctgacaccaaccagtccctggtggaactttggggcttattagactgccgccgaattacctgtcctgaaggctggctgccctttgagggcaagtgttactacttctccccaagcaccaagtcatgggatgaggcccggatgttctgccaggagaattactctcacttggtcatcatcaatagctttgctgagcacaattttgtggccaaggcccatggctctccacgggtgtactggctggggctgaatgacagggcccaggaaggggactggaggtggctggatgggtctcctgtgacattaagcttctgggagccagaggaacccaataacatccacgatgaggactgtgctaccatgaacaaaggtggcacctggaatgatctctcttgctacaaaactacgtattggatttgtgagcggaaatgttcctgttgaagcccagggccgaggctgggggtccatatctgagtgtctctttgagatgagaatctcctgccctttcgtggacggccttgcctcttcgtgagtggacacacagatgtgcctcaaacaggattggcaccctggatgcagcaagttcccaggggtgcaagtcaggctgtttctagagtgaggacttgggcttgccctagtagatggtgagctgggaggatgctcag

SEQ ID NO: 1714 - DNA, 2065 bp, Homo sapiens
agacgcctgagtcggagagacagggggcagaggttgccaagccctggctgccacttgtcaggttccctgtgctagacatgcataatctgtattccatcactgggtacccggacccaccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccaggttcaagtgctccaccaagacctccaagggcagcaaaggaaacagagaaacccccacttccttgcaagccccggaacatgacaggcctggacctcgccgctgtcacctgtccacctcctcaactggctgtgaatcttgagccttctccattgcagccatccctggccgcaactccagtcccctggctcaatcagaggtctggaggtcctggctgctgccagaagaggtggatggtgtacctgtgtctgctggtggtgacttccctgttcctgggctgccttggtctcactgtgaccctgattaagtaccaggagttgatggaagaactgagaatgttaagctttcagcagatgacgtggcgaacaaatatgactggcatggcagggctagctggcctgaagcatgacattgcccgtgtaagagctgacaccaaccagtccctggtggaactttggggcttattagactgccgccgaattacctgtcctgaaggctggctgccctttgagggcaagtgttactacttctccccaagcaccaagtcatgggatgaggcccggatgttctgccaggagaattactctcacttggtcatcatcaatagctttgctgagcaccttctgggagccagaggaacccaataacatccacgatgaggactgtgctaccatgaacaaaggtggcacctggaatgatctctcttgctacaaaactacgtattggatttgtgagcggaaatgttcctgttgaagcccagggccgaggctgggggtccatatctgagtgtctctttgagatgagaatctcctgccctttcgtggacggccttgcctcttcgtgagtggacacacagatgtgcctcaaacaggattggcaccctggatgcagcaagttcccaggggtgcaagtcaggctgtttctagagtgaggacttgggcttgccctagtagatggtgagctgggaggatgctcagagcttggtggtgggaggtctcccacttctggggttgaaaggatcttcactaagttcctgatcatgactcttgggaagtgatactagccctgaggaccctggggctggtgttgaacctgggatgaaatatcctggcgcctgtgaaccacaaagagctgggactgggctccttttcctgcagcctcaaacttctgggctcaggtgatcctcccatctcagcctcctgagtagctgggactacacatgcgcaccaccatgcctggccaattttttgtagcatttaaagagagggagtctcactatgttgcccaggccagtctcaaactccttgcctcaatggatcctcctacttgggcttcccaaattgtgaggattacaggtgtgagccactgtgcctggctcaaaattattattattatttttatagagatgaggtctcactctgttgccgaggctggtctcaaactcctggggtcaagcaatccttccgtgatggcctcccaaagtgctgggattacaggcatgtgtcaccgtacctggccgatatttttatttttatttttactttccccatcttttccttttttttttttttccaaacaaaagctttgaaagtggtgacagaaaaatttccctttgagctagacctctagatctgcctcgcacagaaatacattaagtgggctggtctcatgtagtccccacatcattgcaaattacaaacctaaaaatacagaa

SEQ ID NO: 1715 - DNA, 2475 bp, Homo sapiens
cactgccattggtccacgggacggcccttccaggagccagtggctgggagcagtgctggaggatcaaggaagcagagatggacggtgaggcagtccgcttctgcacagataaccagtgtgtctccctgcacccccaagaggtggactctgtggcaatggctcctgcagcccccaagataccgaggctcgttcaggctaccccggcatttatggctgtgaccttggtcttctctcttgtgactctctttgtagtggttcaacagcagacaagacctgttccgaagcctgtgcaagccgtaattctgggagacaacattactgggcatttaccttttgaacccaacaatcatcaccactttggcagggaggcagaaatgcgagagcttatccagacatttaaaggccacatggagaattccagtgcctgggtagtagaaatccagatgttgaagtgcagagtggacaatgtcaattcgcagctccaggtgctcggtgatcatctgggaaacaccaatgctgacatccagatggtaaaaggagttctaaaggatgccactacattgagtttgcagacacagatgttaaggagttccctggagggaaccaatgctgagatccagaggctcaaggaagaccttgaaaaggcagatgctttaactttccagacgctgaatttcttaaaaagcagtttagaaaacaccagcattgagctccacgtgctaagcagaggcttagaaaatgcaaactctgaaattcagatgttgaatgccagtttggaaacggcaaatacccaggctcagttagccaatagcagtttaaagaacgctaatgctgagatctatgttttgagaggccatctagatagtgtcaatgacttgaggacccagaaccaggttttaagaaatagtttggaaggagccaatgctgagatccagggactaaaggaaaatttgcagaacacaaatgctttaaactcccagacccaggcctttataaaaagcagttttgacaacactagtgctgagatccagttcttaagaggtcatttggaaagagctggtgatgaaattcacgtgttaaaaagggatttgaaaatggtcacagcccagacccaaaaagcaaatggccgtctggaccagacagatactcagattcaggtattcaagtcagagatggaaaatgtgaataccttaaatgcccagattcaggtcttaaatggtcatatgaaaaatgccagcagagagatacagaccctaaaacaaggaatgaagaatgcttcagccttaacttcccagacccagatgttagacagcaatctgcagaaggccagtgccgagatccagaggttaagaggggatctagagaacaccaaagctctaaccatggaaatccagcaggagcagagtcgcctgaagaccctccatgtggtcattacttcacaggaacagctacaaagaacccaaagtcagcttctccagatggtcctgcaaggctggaagttcaatggtggaagcttatattatttttctagtgtcaagaagtcttggcatgaggctgagcagttctgcgtgtcccagggagcccatctggcatctgtggcctccaaggaggagcaggcatttctggtagagttcacaagtaaagtgtactactggatcggtctcactgacaggggcacagagggctcctggcgctggacagatgggacaccattcaacgccgcccagaacaaagcgcctggttccaagggatcctgcccactcagaaagtatattattgtgaattctgggatgggagcttgcagcttcatagacacccctccctgtccctggatcctcagtaactaagagcaacctgagcacagacaccctcagggtactccttctcccagccctgtcctcatcctagggccactaggggatgaaggacccatctcaagtcagctccctagactcatcccatgtcagctccctaggagccacagcaccaggaagggatgctgccttcatctaacagtataaagccctgttgtcttcgggttttgggaaaagaatcagtctgacaactggcggcacaagaatgggcagactgaagactgtgtccaaattcagcagaagtggaatgacatgacctgtgacaccccctatcagtgggtgtgcaagaagcccatgggccagggtgtggcctgagggcaggccagagctgaggggctgctcctgcttgccaatactgaccctcctcctcgatgccttcggagcctctgagctctgcttgttctctgggaccttccgttggccttgtggacttcctgccttgttctttgattcagccctttcaaacatgcttacctcgagtgacccagtgacatcagtggcttctcaagggaagagccttgctgtgcccctgtagcctcagcacccagcacaggcctgtcagacagcaggtcctcaataaatactcgctggatcaacaaaa

SEQ ID NO: 1716 - DNA, 1359 bp, Homo sapiens
agtgcgtaggtccagtgagaacaggcgtgaaatttatatctctgcccaggactgggtgcctgcatcgccatggacaccaccaggtacagcaagtggggcggcagctccgaggaggtccccggagggccctggggacgctgggtgcactggagcaggagacccctcttcttggccctggctgtcctggtcaccacagtcctttgggctgtgattctgagtatcctattgtccaaggcctccacggagcgcgcggcgctgcttgacggccacgacctgctgaggacaaacgcctcgaagcagacggcggcgctgggtgccctgaaggaggaggtcggagactgccacagctgctgctcggggacgcaggcgcagctgcagaccacgcgcgcggagcttggggaggcgcaggcgaagctgatggagcaggagagcgccctgcgggaactgcgtgagcgcgtgacccagggcttggctgaagccggcaggggccgtgaggacgtccgcactgagctgttccgggcgctggaggccgtgaggctccagaacaactcctgcgagccgtgccccacgtcgtggctgtccttcgagggctcctgctactttttctctgtgccaaagacgacgtgggcggcggcgcaggatcactgcgcagatgccagcgcgcacctggtgatcgttgggggcctggatgagcagggcttcctcactcggaacacgcgtggccgtggttactggctgggcctgagggctgtgcgccatctgggcaaggttcagggctaccagtgggtggacggagtctctctcagcttcagccactggaaccagggagagcccaatgacgcttgggggcgcgagaactgtgtcatgatgctgcacacggggctgtggaacgacgcaccgtgtgacagcgagaaggacggctggatctgtgagaaaaggcacaactgctgaccccgcccagtgccctggagccgcgcccattgcagcatgtcgtatcctgggggctgctcacctccctggctcctggagctgattgccaaagagttttttcttcctcatccaccgctgctgagtctcagaaacacttggcccaacatagccctgtccagcccagtgcctgggctctgggacctccatgccgacctcatcctaactccactcacgcagacccaacctaacctccactagctccaaaatccctgctcctgcgtccccgtgatatgcctccacttctctccctaaccaaggttaggtgactgaggactggagctgtttggttttctcgcattttccaccaaactggaagctgtttttgcagcctgaggaagcatcaataaatatttgagaaatgaatccagg

SEQ ID NO: 1717 - DNA, 1176 bp, Homo sapiens
agtgcgtaggtccagtgagaacaggcgtgaaatttatatctctgcccaggactgggtgcctgcatcgccatggacaccaccaggtacagcaagtggggcggcagctccgaggaggtccccggagggccctggggacgctgggtgcactggagcaggagacccctcttcttggccctggctgtcctggtcaccacagtcctttgggctgtgattctgagtatcctattgtccaaggcctccacggagcgcgcggcgctgcttgacggccacgacctgctgaggacaaacgcctcgaagcagacggcggcgctgggtgccctgaaggaggaggtcggagactgccacagctgctgctcggggacgcaggcgcagctgcagaccacgcgcgcggagcttggggaggcgcaggcgaagctgatggagcaggagagcgccctgcgggaactgcgtgagcgcgtgacccagggcttggctgaagccggcaggggccgtgaggacgtccgcactgagctgttccgggcgctggaggccgtgaggctccagaacaactcctgcgagccgtgccccacgtcgtggctgtccttcgagggctcctgctactttttctctgtgccaaagacgacgtgggcggcggcgcaggatcactgcgcagatgccagcgcgcacctggtgatcgttgggggcctggatgagcagggcttcctcactcggaacacgcgtggccgtggttactggctgggcctgagggctgtgcgccatctgggcaaggttcagggctaccagtgggtggacggagtctctctcagcttcagccactggaaccagggagagcccaatgacgcttgggggcgcgagaactgtgtcatgatgctgcacacggggctgtggaacgacgcaccgtgtgacagcgagaaggacggctggatctgtgagaaagcacaactgctgaccccgcccagtgccctggagccgcgcccattgcagcatgtcgtatcctgggggctgctcacctccctggctcctggagctgattgccaaagagttttttcttcctcatccaccgctgctgagtctcagaaacacttggcccaacatagccctgtccagcccagtgcctgggctctgggacctccatgccgacctcatcctaactccactcacgcagacccaacctaa

SEQ ID NO: 1718 - DNA, 1673 bp, Homo sapiens
cgtttgtacccggctgtggcaatctgtggtgaagttgaaatgcttttctgctagactggcaacatgttttgattcttctcaaataactcgcaagctcttgtgaagcacaacggcctaccttgtcctgaagaaaacatactctaaggcccacagatgattaaacccagccatttatgtgacaatagcatttttatttttcttatcaagatctgggtatttgatccacacaatggtaaagattcccatgttagccaagatctaaatgattcaaactgatgatactctctgcagaagaggtgactataaacgcagcccctgtgatgccaactggacatattatggagatagctgctatgggttcttcaaacacaacttgacatggaaagagagtgagcagtactgcactgacatgaaggctactctcctgaagactgacaaccagaacattctgtggatagaagtcaagggctccaatgtctcccaagacgaaagaatcccaagtctcatttggaggaatgctatcactaactaggattcctggagctaaaacattataggagttacttgttccagcctcctgtgtggactgctttcctatcaaagcaccttagacatgcacgaggaagaaatatacacctctcttcagtgggatagcccagcaccagacacttaccagaaatgtctgtcttccaacaaatgttcaggagcatgctgtcttgtgatggtgatttcatgtgttttctgcatgggattattaacagcatccattttcttgggcgtcaagttgttgcaggtgtccaccattgcgatgcagcagcaagaaaaactcatccaacaagagagggcactgctaaactttacagaatggaagagaagctgtgcccttcagatgaaatattgccaagccttcatgcaaaactcattaagttcagcccataacagcagtccttgtccaaacaattggattcagaacagagaaagttgttactatgtctctgaaatttggagcatttggcacaccagtcaagagaattgtttaaaggaaggttccacgctgctacaaatagagagcaaagaagaaatggattttatcactggcagcttgaggaagattaaaggaagctatgattactgggtggggttgtctcaggatggacacagcggacgctggctttggcaagatggctcctctccttctcctggcctgttgccagcagagagatcccagtcagctaaccaagtctgtggatacgtgaaaagcaattcccttctttcgtctaactgcagcacgtggaagtattttatctgtgagaagtatgcgttgagatcctctgtctgaaagaaattgtgttcaaagtgttctattacactgttatttggagcatgccattggaaaacccacccccaccccccctcaaaaaaacagaacagtaaaccaaaatgtgggccatgaaattagcaacctgggactcaataatacacttgggaatattcttccacaccgtccagatttcatttgatgttgttcacattgcaagagtaaaacttatttagagctacagaagacaaaaccctgaagagttaagaacaaacgcaaggaaataatttttattgtttaaagcccggaatgactgtaactttcacacaaggtacgcatctatgtttttggggga

SEQ ID NO: 1719 - DNA, 670 bp, Homo sapiens
ggcagaaaactaactgaaaaacgagaacctactgtatggttagtaatttcttccatgtcatacaagtattcgagaaatctgctaccttgattagtaagactgaacacattggttttgtcatttattcatggaggaagtccaccacccacttggggagcagaaggaaatttgccatctcaatttacttatcagaagtttctttgcagaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggtgagatttaacatttagaggtgacagcatcccccacactggcagtgaattttttgtgctacaaacttggcaaaagtctgtgaaaagaagtttcaacttcatgtgttattaactatacaaatattagttgaatgaattgttgaattaca

SEQ ID NO: 1720 - DNA, 1069 bp, Homo sapiens
caagacattactgctatgctgatcacctttttgctgtaccttcaaatggcatttcttcaatgtgtgtacatctctgatgtctctgtgtatccaaatttcttcttgtaaggacattatcagattggattagggcccaccgcaatggcctcactaaatccaatcttttttgacatatgcatatagaagttcctagacttcagtgctgaggagacagaggctacaggcatccatatgtctgtctctggggtcttcttaggaagaggcctctgatgaagagaacaaagctcttgtttgatatcccagcttgagcaagaggaatgggacaagttcgtggcagccaccagccgccaggagatggctgaagtagacaatcaatttccaggttattgggaaattcaagaccaatcaatagaattatctggagataaactctctgggacagtgttcatcaagttgcagtgccctgtttgagtccgagttagtgttagtcggagatacagtgaagtctaaggaggatgaggaagagtgattggtgatagcagataaaagaaaaatgaatcagtgggataaatggagatgaccaagtttggcgagaagacaatactatgagagaaggtgtccagagacagagtgagacacagatataggaacaggatcctgggccttcctgctccaggaaaagcatggaaaaggcaagttgtgagggcagaagacagtcccacaagaacatgaaattcagtcatgcaaagggctgggaaggcagaaacacagtggtgagagtgagccagaaaggagatgtggggagcaaggactcatggcagagaaggccctggtaaccaagataagaaagtcaactgtgaaggtgaactaagaacacatgatggatgagtggaaaccaggggccagaaagtctttgaaggcagaagatacaaggcaatttgtgggcaggagggaaaaaagtagtgaaaatgtgcaggccaatgtgagaggggcctgtgatggcagagaggaggccaatgatgtgagtaaaaggagcactgcaggaaccggacccagtgtgacgttatga

SEQ ID NO: 1721 - DNA, 1368 bp, Homo sapiens
gaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgca

SEQ ID NO: 1722 - DNA, 2057 bp, Homo sapiens
cttactggggaaaggagagaccaagggctgcttcatgaaggctgtttctgagctgagctttgaacaatagcatgacgagggtaggtggaggtgggagtcagggaagaggactcacctctgctggagctgacagctgaggagtcatgggaagaaagggaggatagaacagaaggccatgaagtagtggcggatgagactggaaagctgagctggtgagagtgaggaagagccttcaagggagggtgtgactttattttctatggcgcaattcaggtaatgggagtctctccagatgcaacacatgttacagcacaactttaatatgattcgtttggcaatagtataaagattccctctctgccctgcaccagtggacagaaatttcaatgataaaaaaggatgaaaacctcaatatgtgacccatgggaaagatagagatggaatcatactcaggagagatgtgttaagctcaatgcacaacacagaaattaaaagcagtctctattttgatgttcattcttgaccaccttcacatccatttcagctattccaaactgtggcggttacctggataccttggaaggatccttcaccagccccaattacccaaagccgcatcctgagctggcttattgtgtgtggcacatacaagtggagaaagattacaagataaaactaaacttcaaagagattttaggccctcattctctagcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgca

SEQ ID NO: 1723 - DNA, 1976 bp, Homo sapiens
gaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgca

SEQ ID NO: 1724 - DNA, 2125 bp, Homo sapiens
gaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgca

SEQ ID NO: 1725 - DNA, 2903 bp, Homo sapiens
ccttctctctggactttgcatttccattccttttcattgacaaactgactttttttatttctttttttccatctctgggccagcttgggatcctaggccgccctgggaagacatttgtgttttacacacataaggatctgtgtttggggtttcttcttcctcccctgacattggcattgcttagtggttgtgtggggagggagaccacgtgggctcagtgcttgcttgcacttatctgcctaggtacatcgaagtcttttgacctccatacagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggctcccttctcaaagcagagccctgaagacttcaatgatgtcaatgaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgcatgtcactgt

SEQ ID NO: 1726 - DNA, 4306 bp, Homo sapiens
agagcagccttggcgctacggaggagcctagggctaaccctcagccatacctggggctggtcctggagttgctacgcagggttgtggcagcactgactgaaggtatgagacccgattctcatccttatggttttccatgggaattggtgatacgtgcagctgttgctggattttttgctgttctcttcttgtggagaagttttagatcagttacgagtcggctttatgtgagaagagagaaaaagtttgctgtggcactttctggactaattgaagaaaaatgtaaactacttgaaaaatttagccttgttcaaaaagagtatgaaggctatgaagtagagtcatctttaaagaatgccagctttgagaaggaggcaacagaagcacaaagtttggaggcaacctgcgaaaagctgaacaggttcaattctgaacttgtgcatgaaatactctgtctagaaaaagagttaaaagaagagaaatctaaacattctgaacaaaatgaattgatggcggatatttccaaaaggatacagtcgctagaagatgagtcaaaatccctcaaatcacaagtagctgaagccaaaatgaccttcaagagatttcaagcgaatgaagaacggttggagatagaaatacaagatgcttggaaagaaaattctgaacttcaggaaagccagaaacagcttttgcaagaagctgaagtatggaaagaacaagtgagtgaacttattaaacagaaaagaacatttgaagactccaaagtacatgcagaacaagttctaaatgataaagaaaatcacatcaagactctgactgaacgcttgctaaagatgaaagatggggttgctatgcttgaagaagatgtaacggatgatgataacttggaattagaaatgaacagtgaatcggaagatggtgcttacttagataatcctccaaaaggagctttgaagaaactgattcatgctgctaagttaaatgcttccttaaaaaccttagaaggagaaagaaaccaaatttatattcaattatctgaagttgataaaacaaaggaagagcttacagagcatattaaaaatcttcagactgaacaagcatctttgcagtcagaaaacacacattttgaaagtgagaatcagaagcttcagcagaaacttaaagtaatgactgaattatatcaagaaaatgaaatgaaactctacaggaaattaatagtagaggaaaaatgccggttagagaaagaagagaaactttctaaagtagacgaaatgatcagccatgccactgaagagctggagacctaccgaaagcgagccaaagatcttaaagaatttgagaaaactattcatttttatcaaaagaagattattctccatgagaaaaaagcacatgataattggtcggcagcttggactgctgaaagaaacctcaatgatttaaggaaagaaaatgctcacaacagacaaaaattaactgaaatagagtttaaaataaaacttttagaaaaagatccttatggacttgatgttccaaatacagcatttggcagacagcattccccatatggtccctcaccattgggttggccttcatctgaaacgagagcttctctctatcctccaactttgttggaaggtcctctcagactctcacctttgcttccacggggaggaggaagaggctccagaggcccagggaatcctccggaccatcagattaccaaagaaagaggagaatcaagctgtgataggttaactgatcctcacagggctccttctgacgctgggcccctggcacctccgtgggaacaggactataggatgatgtttcctccaccaggacaatcatatcctgattcagctctccctccacaaaggcaagacagattttattctaattgtgctagactctctggaccagcagaactcagaagttttaatatgccttctttggataaaatggatgggtcaatgccttcagaaatggaatccagtagaaatgataccaaagataatcttggtaatttaaaggtgcctgattcatctctccccgctgaaaatgaagcaactggccctggctttgttcctccacctcttgctccaatcagaggtttattgtttccagtagatacaaggggcccgttcataagaagaggacctcctttccccccacctcctccaggaaccgtgtttggagcttctccagattatttttctccaagggatgtcccaggtccaccacgtgctccatttgcaatgagaaatgtctatttaccgagaggttttcttccttaccgtcccccaagacctgcatttttccccccagcccccacattctgaaggtagaatgagtttccatcagggttgagtccgacttcaaatgagcctgctgctgaacatccagaacgacagcaagaaacctaacaacatgtttgccctcttcaaaagtaattttgactgatctcattttcagtttaagtaactgctgttacttaagtgattacacttttgttcagattgaaacttaatggaactataattcccaggatagtattttgtaaatgaggatgatttaaatatgaatcttatgagtaaattatttcattttattttattctagatagtataacttttaatttgattaatccactattatataaagaatggtgggagctttatatatgtaatcttgcaggtggggaggctttaaattgtctttatgtcaagaactgtatttactgtggttgtagacaaatgtgaaagtaactttatgcttaaataagttttagttgattaaaaaaatttaaaaaatttaaaaaaagaaatatataaatatgcacaggtgggaaggtagaatactatgtaactgttagaatatttcactttaaaccaagatgatcttggatctcctgtcttatagattttatatcctctttcagtactttgagagtgtaaaacatttatagcagaaagtattcgtgtttcctctgttttcctcaagaatggtttcttcgccctccctttccttcccttcgtcttccctaagctaatttcttcctatgtttgtcatcatatcattacataattgtgttgttatttcttttgttttatttttatttggtgggaacaactttatccagaacttttacttgccccagaattatatagatcagtttctcctgacttctttcccaacctttacctctgttggtgttctaatagttttagttttatgttctgcttttctcttgctgtggcaaggggaaggagtaaatctaagatagtgcttaattgcagttggtgaatttgatctctgattgagctctcttctctggaattctgttaaaagatgaaatgtatcgtgttccctgagagacgccctcaaattttggattagtccttcatgcaagctgggccaccaagccattgcttcttttggggacaacctgccctcacttttaaaaagcatcctagctcacatgcctcccctagcagttaatgccactccagtctctgcttgaatgtaataaaataaaagaaaagtaactatttgagacatgaggtgcccttattgtacactggggcttcctatacattttccgtcttcccttgaaccaccactatcctcagctactttatgcttctgttctgttaaagccctatttgctagtggaaaaatttaactcctggtgatttttttaatactaggcctcttgccttccttccagtgagagaaaaatagaatggtaagcctagtggtttcttccttcactgttgaatactatttatccaaggtatcaaggaagaacttctaatcagaaaagacatgtattattttcacaactgggtagcatatctcactcccagaatggaagttaggtgggaattgcaagattaaggagatttttctggatttctgtctatgtatcatatccacagaactctttctagaggaattttatattgagccaggcatccatttccacagtcttgcatttctagatacttccaaagttatagcactgttcctaaatcatttttggctttatttattaatttattgttcacttcatttcattaggttcagtatgaaacaggtattgtcatctctttgtgtctactttgccacctttccccagaataggcctgaatgagattgaaaacgttacttcagttccttgtgtctgacattgcttgtttgtaactaagaaaaataatatttgcttttgttgaatgactactaatttttttccatgaacctaataaactaaaaagaaagttgaaataataaagagtgaataagt

SEQ ID NO: 1727 - DNA, 1267 bp, Homo sapiens
ctaatttcttcctatgtttgtcatcatatcattacataattgtgttgttatttcttttgttttatttttatttggtgggaacaactttatccagaacttttacttgccccagaattatatagatcagtttctcctgacttctttcccaacctttacctctgttggtgttctaatagttttagttttatgttctgcttttctcttgctgtggcaaggggaaggagtaaatctaagatagtgcttaattgcagttggtgaatttgatctctgattgagctctcttctctggaattctgttaaaagatgaaatgtatcgtgttccctgagagacgccctcaaattttggattagtccttcatgcaagctgggccaccaagccattgcttcttttggggacaacctgccctcacttttaaaaagcatcctagctcacatgcctcccctagcagttaatgccactccagtctctgcttgaatgtaataaaataaaagaaaagtaactatttgagacatgaggtgcccttattgtacactggggcttcctatacattttccgtcttcccttgaaccaccactatcctcagctactttatgcttctgttctgttaaagccctatttgctagtggaaaaatttaactcctggtgatttttttaatactaggcctcttgccttccttccagtgagagaaaaatagaatggtaagcctagtggtttcttccttcactgttgaatactatttatccaaggtatcaaggaagaacttctaatcagaaaagacatgtattattttcacaactgggtagcatatctcactcccagaatggaagttaggtgggaattgcaagattaaggagatttttctggatttctgtctatgtatcatatccacagaactctttctagaggaattttatattgagccaggcatccatttccacagtcttgcatttctagatacttccaaagttatagcactgttcctaaatcatttttggctttatttattaatttattgttcacttcatttcattaggttcagtatgaaacaggtattgtcatctctttgtgtctactttgccacctttccccagaataggcctgaatgagattgaaaacgttacttcagttccttgtgtctgacattgcttgtttgtaactaagaaaaataatatttgcttttgttgaatgactactaatttttttccatgaacctaataaactaaaaagaaagttgaaataataaagagtgaataagtataaaaatc

SEQ ID NO: 1728 - DNA, 13747 bp, Homo sapiens
ccgcggcgccgggacagccccgggactctgccaggtggatgttgtgcgtagccggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcgggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaa

SEQ ID NO: 1729 - DNA, 2930 bp, Homo sapiens
ctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcagagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcc

SEQ ID NO: 1730 - DNA, 13762 bp, Homo sapiens
ccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcgggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaa

SEQ ID NO: 1731 - DNA, 2331 bp, Homo sapiens
actccgtctcaatatgtctcaagatggcggccaatgtgggatcgatgtttcaatattggaagcgctttgatttacagcagctgcaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcagagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctc

SEQ ID NO: 1732 - DNA, 2776 bp, Homo sapiens
atgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcagagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcc

SEQ ID NO: 1733 - DNA, 2991 bp, Homo sapiens
gttttggcgccgcccgcctgctgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcagagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcca

SEQ ID NO: 1734 - DNA, 4212 bp, Homo sapiens
atgttgtgcgtagccggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctga

SEQ ID NO: 1735 - DNA, 2878 bp, Homo sapiens
ctccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcagagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcc

SEQ ID NO: 1736 - DNA, 4452 bp, Homo sapiens
atgttgtgcgtagccggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcgggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctga

SEQ ID NO: 1737 - DNA, 4350 bp, Homo sapiens
atgttgtgcgtagccggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcgggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctga

SEQ ID NO: 1738 - DNA, 4044 bp, Homo sapiens
atgttgtgcgtagccggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctga

SEQ ID NO: 1739 - DNA, 2965 bp, Homo sapiens
aaagtgccaggaacccatatcgcatgcaagcgtgtgtgttcaaattagccttctccagggaggaattcacagcaccaggaatacgcgcagagatgttcttttgcacttttgcattttaaaacgtgcatcgcttacgagcgcagcattttcaagccttttcttgagatcagctcgttcagttacatgtgcttttgaagatgaccatttgtgaaaccatcagccactggcaaagtgaagaaaaatgaagatttcggcctggttgatgtgtgctcggggaaaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcagagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagt

SEQ ID NO: 1740 - DNA, 3492 bp, Homo sapiens
ggggctaaaccgacagggtattgctgggcatggaggaggttgggtccaggttttttgctctttgtgactttttaatgcctttcagatgtgacgactctccatacgccttctcacacgtgacccgtgactcatgggccgaggcctctgcatttgggacccccacctccacctccccaagatgcatttcattcccttgttaatgtgtcattgtagttgacgctttgaggataggcaggcttggtagataataaaacagtatttggcttatgtttaatcgctgtctcctcccacagcccgagaacgccttagcgtccttcagaaaggatttggtggtactggtttttatgtgtgtgtgtgttgttttttaaaaaaattttctccaagggacctggtcaaagatttcaagccttaaatctgatcaacccaatctggggcggcggcagctcagtctctcctcctcgctgtgccaatctgtttctgtggtggcgggtggcggctcggtgttaaatttggagacccccgtgggtttcccatgccgacctgcatatgtctgcgggcacggggaagggagggccgcagacccccgttgagtccccgactgccagcagcaagttgccgcaggcgcactggctctgcagccccgggatcaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcagagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcc

SEQ ID NO: 1741 - DNA, 2296 bp, Homo sapiens
agcccacactgcggagccaggcggcagcatggaccgggctggggcagacatgtgggccagcaccttcaccctggccatggccgagaggaagccccaggacgtctgggttctgctacctgagcacagcctggtcccgggatgcctggacggcggtggtgtccagtacctgctggtggggctctcgaggctccagtgcggtcactgtccggggacctgggactcggcccatgtgcacgtcctcttccacctgtggtgggacagggccagccaccgggggctggtgaagatgcgcatctggggccagcggtgcaggctgtgccccgcacccggggactgccaggtgaggcccccgggcgagcagcccttcctcagcaggctggtcttgcacatcctgcaggactgctacggggatggccccggcccagcccggcaccccagggaggcctatgagggctgctgtgaggcctgtgagctgggggtctgcttcctccagaaggccccagaccccgcctggagcgccaacgccacaaaaggcaacttccccgccacggcctggggtggcactggcaccgtctccaggggcaaaccgctgtccacccctggcgacgaccttggcaagggtggcgttgtcatcgccatccccttctcccttgtgggtaccagcaatgaccaggtgcccatcgctgagggccctgccccccctgcgggggcctctctccctgtgactggcagctgtgaggccctggtcatcggccagggctccatcttcctgtctggggattcagtggccatgcctgggggcaaaggcttcccggtggccattggagaccccctcttccacggccccggcctcctcggcagcagcatccagaccttcgagctcaagggcttcctcttcaaaggccggggctccctctgcagcccggttggcgtggcccagggctggggccccatctccctcaacaatggcctcgtccctgtggggaaacacacgccaaccgtgttctactgtgtgggcctctcggccagcggggagggctccctcaccttcccctcctccctcaccagcatcttcaccaacaccctctcggagcccaccgatggccctgtggccactaaagaggcctccatcaccttccccttcatctttactgatgtcaaggatgccgttgctgaggtggctgaaggcaacgggaaggaaggaggcggccagggcctcgtcccagtgggtcacgacgccctgccagagaccaatgctggtggcctcccctcccaggtcaagggctcccttgccctccccttccctgctgatgtccaaggcaaagatgcctttactgacatcactgaaggcaaagagaaggaaggtggcctggtcaccgcgggtcacgacgcccctctggaggccaatgccgagggccccatcacggttagtgagggctgcatcaccatccccttcgcagtcttcgatgtcataaagcgcaagggcggtggccacgttgcctacggcccccagggcaatggctgcttctcccaaggctattaccagaagaggcagctgaggtccaggttccacaaggcccgctgtgggtgccgccgggaggaagacgagcgccctggccgtgcctgccgtaggccgcacgccgagccctacgaggacttctggatctgggtgtccatgaccgtgtgcgtcttctggctgatgtgcatgtgtcggctgaaccccgggatctacccgcagcaagtgtgacgccccgaagttcaggcaaccctcgcctctgggaccccgcctcgcctctgagacaccccccaaccccgcctttgagatgcccgccccgcctccgagaccccgcctccacctccgagacccctttctctgagacccccgcctctgaggccccgccccccgcctccgagaccccgccctgcctctgagaccccgcctcacctctgagacaccccccaaccccacctttgagatgcccgccccgcctccgtggccccgcctccacctccgagaccccgcctccacctccgagacccctttctctgagacccctgcctctgaagccccgccccccgcctccgagaccccgcttcacctccgaggccccgccccccgcctccgagaccccgccccccgcctccgagaccccgcctcacctctgagaccccgcccccgccagcagctcagcccctcctgtctcttgcccctggttttgtgggtctgccctgagctgtgcctgtgtgctccagcctcttcctatgtgtgtaacttcaataaaaccaagcaaagcca

SEQ ID NO: 1742 - DNA, 1863 bp, Homo sapiens
agaagcccaacagcagcctccttcaggcagtcaggcactagtgcccaactccagaagtcccctacaggcagagagggtgtggacatctcacaccccagcaccagaccacagaaccatgagccaggacaccaaagtgaagacaacagagtccagtcccccagccccatccaaggccaggaagttgctgcctgtcctggacccatctggggattactactactggtggctgaacacaatggtcttcccagtcatgtataacctcatcatcctcgtgtgcagagcctgcttccccgacttgcagcacggttatctggtggcctggttggtgctggactacacgagtgacctgctatacctactagacatggtggtgcgcttccacacaggattcttggaacagggcatcctggtggtggacaagggtaggatctcgagtcgctacgttcgcacctggagtttcttcttggacctggcttccctgatgcccacagatgtggtctacgtgcggctgggcccgcacacacccaccctgaggctgaaccgctttctccgcgcgccccgcctcttcgaggccttcgaccgcacagagacccgcacagcttacccaaatgcctttcgcattgccaagctgatgctttacatttttgtcgtcatccattggaacagctgcctatactttgccctatcccggtacctgggcttcgggcgtgacgcatgggtgtacccggaccccgcgcagcctggctttgagcgcctgcggcgccagtacctctatagcttttacttctccacgctgatactgactacagtgggcgatacaccgccgccagccagggaagaagagtacctcttcatggtgggcgacttcctgctggccgtcatgggtttcgccaccatcatgggtagcatgagctctgtcatctacaacatgaacactgcagatgcggctttctacccagatcatgcactggtgaagaagtacatgaagctgcagcacgtcaaccgcaagctggagcggcgagttattgactggtatcagcacctgcagatcaacaagaagatgaccaacgaggtagccatcttacagcacttgcctgagcggctgcgggcagaagtggctgtgtctgtgcacctgtccactctgagccgggtgcagatctttcagaactgtgaggccagcctgctggaggagctggtgctgaagctgcagccccagacctactcaccaggtgaatatgtatgccgcaaaggagacattggccaagagatgtacatcatccgagagggtcaactggccgtggtggcagatgatggtatcacacagtatgctgtgctcggtgcagggctctactttggggagatcagcatcatcaacatcaaagggaacatgtctgggaaccgccgcacagccaacatcaagagcctaggttattcagacctattctgcctgagcaaggaggacctgcgggaggtgctgagcgagtatccacaagcacagaccatcatggaggagaaaggacgtgagatcctgctgaaaatgaacaagttggacgtgaatgctgaggcagctgagatcgccctgcaggaggccacagagtcccggctacgaggcctagaccagcagctggatgatctacagaccaagtttgctcgcctcctggctgagctggagtccagcgcacttaagattgcttaccgcattgaacggctggagtggcagactcgagagtggccaatgcccgaggacctggctgaggctgatgacgagggtgagcctgaggagggaacttccaaagatgaagagggcagggccagccaggagggacccccaggtccagagtgaccccatccccatccccagga

SEQ ID NO: 1743 - DNA, 1848 bp, Homo sapiens
aattcccccagcgagggagggaggcccccggcggccgggagcctgcgagccgcggcgggacccgagcgcacgcaggggcgcggcgacggcgggggctagtcgggctgcggaggcggccgtcgggagtgcggagcgcctcggacgagggtccaaccgccggcaggcaccagagggcacggctggctcggcactgggaggggcccggcgctcgcagccccccacgcccagagaggatgcggtgcgccctgagagccgggtagcctcggatagcggcgctgcgtacgcgatgatggatgagccgtggtgggaagggcgcgtcgcctcggacgtccactgcaccctgcgcgagaaggaactgaagctgcccaccttccgagcccactccccactcctgaagagccgccggttcttcgtggacatcctgaccctgctgagcagccactgccagctctgccctgcagcccggcacctggccgtctacctgctggaccacttcatggatcgctacaacgtcaccacctccaagcagctctacaccgtggccgtctcctgcctcctgcttgcaagtaagttcgaggatcgggaagaccacgtccccaagttggagcaaataaacagcacgaggatcctgagcagccagaacttcaccctcaccaagaaggagctgctgagcacagagctgctgctcctggaggccttcagctggaacctctgcctgcccacgcctgcccacttcctggactactacctcttggcctccgtcagccagaaggaccaccactgccacacctggcccaccacctgcccccgcaagaccaaagagtgcctcaaggagtatgcccattacttcctagaggtcaccctgcaagatcacatattctacaaattccagccttctgtggtcgctgcggcctgtgttggggcctccaggatttgcctgcagctttctccctactggaccagagacctgcagaggatctcaagctattccctggagcacctcagcacgtgtattgaaatcctgctggtagtgtatgacaacgtcctcaaggatgccgtagccgtcaagagccaggccttggcaatggtgcccggcacaccccccacccccactcaagtgctgttccagccaccagcctacccggccctcggccagccagcgaccaccctggcacagttccagacccccgtgcaggacctatgcttggcctatcgggactccttgcaggcccaccgttcagggagcctgctctcggggagtacaggctcatccctccacaccccgtaccaaccgctgcagcccttggatatgtgtcccgtgcccgtccctgcatcccttagcatgcatatggccattgcagctgagcccaggcactgcctcgccaccacctatggaagcagctacttcagtgggagccacatgttccccaccggctgctttgacagataggccacctccagacctcacgaggaagccttggagatgtgggcagaggaagaggacactgaagaggagagctcagccaagtgaggcagcaggaggccatccctgaagagccttggaacgtggagggtctgtgctccttttaaataaaactgacccagagcaaaacattcaataacatacctcacccgagagcattcctctgagaaacgtctgccacgtgtggctagggtacaaaaggatggcttggtggccgtccccccacacaggggcccagtgaatcgagaaagacttgataagaggccaggagagtgggaactggacacagaccactgatctcaagcatgtccagtttttagcattaaagacttttctattctttgctgatggcagctacaccgctg

SEQ ID NO: 1744 - DNA, 3320 bp, Homo sapiens
aattcccccagcgagggagggaggcccccggcggccgggagcctgcgagccgcggcgggacccgagcgcacgcaggggcgcggcgacggcgggggctagtcgggctgcggaggcggccgtcgggagtgcggagcgcctcggacgagggtccaaccgccggcaggcaccagagggcacggctggctcggcactgggaggggcccggcgctcgcagccccccacgcccagagaggatgcggtgcgccctgagagccgggtagcctcggatagcggcgctgcgtacgcgatgatggatgagccgtggtgggaagggcgcgtcgcctcggacgtccactgcaccctgcgcgagaaggaactgaagctgcccaccttccgagcccactccccactcctgaagagccgccggttcttcgtggacatcctgaccctgctgagcagccactgccagctctgccctgcagcccggcacctggccgtctacctgctggaccacttcatggatcgctacaacgtcaccacctccaagcagctctacaccgtggccgtctcctgcctcctgcttgcaaacggagtttcgctcttatcgcccaggctgaagtgcagtggcatgatctcagctcattgcaacctccacctcccaggttcaagcaattctcctgcttcagcgccccaccccccacccacaccgccccaagtagctgagactacaggtaagttcgaggatcgggaagaccacgtccccaagttggagcaaataaacagcacgaggatcctgagcagccagaacttcaccctcaccaagaaggagctgctgagcacagagctgctgctcctggaggccttcagctggaacctctgcctgcccacgcctgcccacttcctggactactacctcttggcctccgtcagccagaaggaccaccactgccacacctggcccaccacctgcccccgcaagaccaaagagtgcctcaaggagtatgcccattacttcctagaggtcaccctgcaagatcacatattctacaaattccagccttctgtggtcgctgcggcctgtgttggggcctccaggatttgcctgcagctttctccctactggaccagagacctgcagaggatctcaagctattccctggagcacctcagcacgtgtattgaaatcctgctggtagtgtatgacaacgtcctcaaggatgccgtagccgtcaagagccaggccttggcaatggtgcccggcacaccccccacccccactcaagtgctgttccagccaccagcctacccggccctcggccagccagcgaccaccctggcacagttccagacccccgtgcaggacctatgcttggcctatcgggactccttgcaggcccaccgttcagggagcctgctctcggggagtacaggctcatccctccacaccccgtaccaaccgctgcagcccttggatatgtgtcccgtgcccgtccctgcatcccttagcatgcatatggccattgcagctgagcccaggcactgcctcgccaccacctatggaagcagctacttcagtgggagccacatgttccccaccggctgctttgacagataggccacctccagacctcacgaggaagccttggagatgtgggcagaggaagaggacactgaagaggagagctcagccaagtgaggcagcaggaggccatccctgaagagccttggaacgtggagggtctgtgctccttttaaataaaactgacccagagcaaaacattcaataacatacctcacccgagagcattcctctgagaaacgtctgccacgtgtggctagggtacaaaaggatggcttggtggccgtccccccacacaggggcccagtgaatcgagaaagacttgataagaggccaggagagtgggaactggacacagaccactgatctcaagcatgtccagtttttagcattaaagacttttctattctttgctgatggcagctacaccgctgaaaaaggaggggcagcctggcgtgttctcaggacccccggaggatcccatattgggtgcttttctttccctggctctatgcagaggggcctgagttggtgtgtatgcctgagtgtttgccttgcgaggcacagtgggtggctgtcttgcctttgttttcgaacctaaaaccattttcagccttttagatatgtcatgtgctgctgcttcccgaagtggtcttgctttctgtttcgtaagatgtcttgtttacacactgtatcagggatttggtgatacttgaaaattcctttggagaaaaaaacaaatttaattgccacactgcctgtcccacatgagggctgttaatttggaacccaagtttgaacccaacttgtgatggacccgcaggtaaccacagagcttcctttttgaaggcatatggttggagagaaccattttcccagctctcggttccggaagattccacgtcttggaggctgtgttcaccactagaactttaataactacccagggagggagaagctcgttgaaaggaagacaaagatttaaacagttcccacctctctccaccacatacttacagggcatgagtttaacccagtctaggctttgagtgtggctgatagcgaaggatagcaatgtggaaaatttgcttagtcccacctgtatttggggagtgggatgtacatgggcgtttgataccaccattgataggcaagcgactggttggatcaaaagccagtatttagggatctgcagcgagagggccctcaggaagactcttgtaaccatgtgcaatatgtttttattctgactcgcagcttgtgctcagcatgttctttggtttagtttggggttgggggacacattgttcacccagcagaactgggaggtgcaaaggaccgtggaagcaatttttgttttgtttgaggaatacctgtcttggattccttagccccttgccagtcctggagactgtggcaggggccgccaggaaggcagctgtctgctgctgagtcagatcggaaggtggtgaatctttccagagcagctgaaaatctcagcatggagacagtaagaaaagagacggggtgtggataagactctgccaccgtgtcacactagcataggaggctgcacgttcatttgttgttgtttttttttcctttgccaacctccgttctatttatgtgcaagcagtttggattcaagttcttgtatctgtctgttctgggacctggggattgtgagggttccctcacagccagcacgacccccagaaagaggcgtcccacaataaacacgtcacctgctcttgatctctca

SEQ ID NO: 1745 - DNA, 501 bp, Homo sapiens
atgaggcatacgtctaaaagaaaaccacaatattatgaggctgaaatggtactgaaatattacaaacacttggaggaaggcagtgtctcgctctgttgcccaggctggagtgcagtggcacaatcacggctcactgctgcctcaacctttggtgctcaagtgattcttctatttcagctttctgagcagctaagactacaggaactgaagctgcccaccttccgagcccactccccactcctgaagagccgccggttcttcgtggacatcctgaccctgctgagcagccactgccagctctgccctgcagcccggcacctggccgtctacctgctggaccacttcatggatcgctacaacgtcaccacctccaagcagctctacaccgtggccgtctcctgcctcctgcttgcaagtcggaacaaaggatcagggtccccagtgcccacacgttcagcgcagcagtgccgtcagacctgggccagaggcagcccctggtga

SEQ ID NO: 1746 - DNA, 940 bp, Homo sapiens
agtgcggagcgcctcggacgagggtccaaccgccggcaggcaccagagggcacggctggctcggcactgggaggggcccggcgctcgcagccccccacgcccagagaggatgcggtgcgccctgagagccgggtagcctcggatagcggcgctgcgtacgcgatgatggatgagccgtggtgggaagggcgcgtcgcctcggacgtccactgcaccctgcgcgagaaggaactgaagctgcccaccttccgagcccactccccactcctgaagagccgccggttcttcgtggacatcctgaccctgctgagcagccactgccagctctgccctgcagcccggcacctggccgtctacctgctggaccacttcatggatcgctacaacgtcaccacctccaagcagctctacaccgtggccgtctcctgcctcctgcttgcaagtaagttcgaggatcgggaagaccacgtccccaagttggagcaaataaacagcacgaggatcctgagcagccagaacttcaccctcaccaagaaggagctgctgagcacagagctgctgctcctggaggccttcagctggaacctctgcctgcccacgcctgcccacttcctggactactacctcttggcctccgtcagccagaaggaccaccactgccacacctggcccaccacctgcccccgcaagaccaaagagtgcctcaaggagtatgcccattacttcctagaggtcaccctgcaagatcacatattctacaaattccagccttctgtggtcgctgcggcctgtgttggggcctccaggatttgcctgcagctttctccctactggaccagagacctgcagaggatctcaagctattccctggagcacctcagcacgtgtattgaaatcctgctggtcccccttttcagatgaaaaatcctaggccccagcg

SEQ ID NO: 1747 - DNA, 940 bp, Homo sapiens; identical to SEQ ID NO: 1746

SEQ ID NO: 1748 - DNA, 2060 bp, Homo sapiens
gcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatatgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctctcgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgctcctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 1749 - DNA, 2073 bp, Homo sapiens
tgacgaagtaccccgggttccgagtccgggtctaggtccaggcagtcgagcccgttttcttatcccacagtaggcagggcggctagggagtgtggtgctgccccggtatccccgtgtggggcaggaagtgggcttccagattcccagtatccccggtagggtctgcttctgctcgctcgggaagggcggtggccgtcccattactcaaccaaccctcaacgcactggtcctcccagttccctcccctcagtgggtaaacaaacacacaccagcgcttgactcgacagactcgaaaacaacatctactcagaaaagttgtttctttcctatctccttaaactttcccacttccacatatcggagcttcttcccacctcggcctactcaagcatgagatcggaggcgggagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatatgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctctcgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgctcctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagc

SEQ ID NO: 1750 - DNA, 1154 bp, Homo sapiens
aggcgcctggggcttggccacgttccgtgagaccaggagttcgagtccggttcctgcccgcgggtcggggcgggaggctgggccagatgggcggcaggaagtgccaggcgctgacttgcaggcggcacccccgcggcttgtaaacgccgggcggacgcggcacaggcggagtacgcgcctcgcagccgcatctcctttctgctccgcgagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatatgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctctcgctaatgtctccagctgcctggaaggcagcatggggctgcggtcactct

SEQ ID NO: 1751 - DNA, 4953 bp, Homo sapiens
gcatccccttgattaaatgtttttcctcctatgcaatcaccattagctgtttggctcccattctgtattcttctgaagcagccctgcattgcaaatcaatatctttctgaaaagacagtgtgttgtgaattgccttgacagcatatgcacggttactttggctgcaatgctgctgcagagcccggttactctgccttcgtgggaactccacagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgt

SEQ ID NO: 1752 - DNA, 4995 bp, Homo sapiens
cgtcgcttcccggcccgccgaggaggtggtggaggaggaggcgccgctttccccgcggcgcgcgccctcgccgttgtctgagctgtgcctggaccagtttggggaagttgtcggggctccgcgtcgcccagatgtgtgacctcattgagccgcagccggccgagaagatcggcaagatgaagaagttgcggagaactttgtcggagagtttcagtcgcattgctttgaagaaagatgacaccacctttgatgagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgta

SEQ ID NO: 1753 - DNA, 1514 bp, Homo sapiens
agttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaag

SEQ ID NO: 1754 - DNA, 1687 bp, Homo sapiens
gggggcgggggcagataggaggtgcctgctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtcgcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgctcccgagtgctgcctcctggtcaaggagaagtgcagagagtaa

SEQ ID NO: 1755 - DNA, 2175 bp, Homo sapiens
ctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtcgcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtggtaccgagcccccgagctcctgtatggtgcccgccagtatgaccagggcgtcgatctgtggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatt

SEQ ID NO: 1756 - DNA, 2176 bp, Homo sapiens
gtcgcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagccgagggtgggctggcagtgtctgccttctatcctgcagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttacggtatcagataccaatatttaaaagtttgtataataataaagagtatgattgtggttcaaggat

SEQ ID NO: 1757 - DNA, 2202 bp, Homo sapiens
gggggcgggggcagataggaggtgcctgctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtcgcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttacggtatcagataccaatatttaaaagtttgtataataataaagagtatgattgtggttcaagg

SEQ ID NO: 1758 - DNA, 2301 bp, Homo sapiens
gctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtcgcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttacggtatcagataccaatatttaaaagtttgtataataataaagagtatgattgtggttcaaggat

SEQ ID NO: 1759 - DNA, 3101 bp, Homo sapiens
agtcgttgccacccgcggagatgaaatgtgagcctgggtggccaaggacgccggagtggccgccttccccgcgcctgagcgcagtggggcgagacaaagagacctgggcccccagcgcagcccgtctcgggccacgggcgccccagctccgcggagtcccgcagtcgctggcccgggacgcgcccggcccgggctcccttggaaggctccctaggcaatggccgggtctctgctccacccggctctcaggagcgctgctctctccatctgatcgccctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcgggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctggaccaccaccctacggtcacgaccacgagatggaatactgtgcagacttgcctcctccatactcccccaccccacagggtccagcacagcgttctccaccccctccttatcctggaaacgcaaggaaataatctatctcccagaacagaacatgtgccaatgggcgatcttgcctggaataaaatgcctctactcagaaacaggcaggaaagaattgctccaaggaatactttttggggtcagataatgtgtcaggtggaatatccctgctaggagatataggatttctactctgctcaaagctgaccccatctggagtattaatgtttggttctatggaaccacattttaagagatctgctgatccacctaagcacattcagggaagagtaatgtaattgacaaaatatctgataatcatgttgtttaagggctaggtgaagaaagtttcagtattgatcctggaaaaaaagaagatctaagtaggatgggagaatgatttggcccacacaaggaagcaactttattctatatagctttaaaagtcagaactagaattgttcattctttcattcatcaataaatgtattttgagtgcctaagagtttactatgtgcctagcactgtttgaggtcctgatggaagttacaggacgggtactctggttttagtacaagaaagagcaatgactagattgctttgtgaagctcttggtagagacacgctccagaagggataacaaaatcaaatagtagatgggttcattgggcctcagaagttctgctcgtattttaggtgggtgtgaagtgaatttctatatgtccaggagtgaatacaacagaaagagttggatcttatttatttaattagggagttaaaacaagaccaaaaagactcaacagccgcttgaagccaagaactcttcaatgccagctactgccacctaaaaatcatctggctttatagtggatcagaataaaggttattctaactgtggggagaaaaaaaaaattgtatcaagttccacaggtagcagacacttcacttccaagtaaaagatgagaaatcaattattcccacaggattttaggtcagggagcaaaaatctcagaacttgaccatgaagatacacaacagactcgcaaaaataaagtgggaaatgaagttcagattcccttctgtagatttccttaaaactattatttttttcttcttcgtaaaattttgataatctgttctcttaaaaaagttaatgacacaattaagatactgacatcaaattgttgccttttaccaaaatgcaaattttatgaagtgcctacctttatatgtataaagcatttaataaataattctaatgtgccatattttgctgtgagtgaccttaacatttatatttttatatgaattgtttcatgtatttataaaaattgtatattgaacattggaaatagatgattagatttttgtgtcattttacaattaaatctaaaatgcttaatccaatatcatcatcaaaattcagtgaaatcccaaaacagtgccaagaattttgctgaatgaaacaatcaaacaaagcattttaaggtgtaagttatagtacctgtacttgcagataagaagcttactatatcattattataagtagcatatattactttcaaatacctatattagaaagatattgatctgactgaaatataacctacctgccagtaaggtccaaaggctgaatttgttttgaatgagttccttgatctttaagcactgatgattttcttatatatgaggatgcaaagcattcaagagtttcagcctgttctggtgaggggctccctgacttacataaagttttcagtgcaattttaatagtacatatgctttaatttatttttcttctgcgtgtggtcagacccaattacactgtggctaagactctcaaagtgccagggtttctgtgatgattctgagaatgctgaatacaaatataccttatattctttaaggaaaacggaaaggaaagatcagcagaaatagggttttctcatcttcaccatcaataaacatttattgcgtacctcctatattctgcaaattttccccaaatagaagccagttcagtccacaccatctcttctttgagttgtttatggcctcccttaaggcattttacaaacccataagcctacaatagatgagtatttttactatttgtattaagtgtcataatagcatcaatgtgcacattaccagtatagactgttggagttcactgattgttttcatagatgatgcttcttggggaaaaatagtataggatgtgaaagttttgaattacggttatttaaaaactaacatttgctatggccaaagtgtttacaataagcaataaagtgaaagaacctattataacacagattata

SEQ ID NO: 1760 - DNA, 1312 bp, Homo sapiens
agtcgttgccacccgcggagatgaaatgtgagcctgggtggccaaggacgccggagtggccgccttccccgcgcctgagcgcagtggggcgagacaaagagacctgggcccccagcgcagcccgtctcgggccacgggcgccccagctccgcggagtcccgcagtcgctggcccgggacgcgcccggcccgggctcccttggaaggctccctaggcaatggccgggtctctgctccacccggctctcaggagcgctgctctctccatctgatcgccctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcatgctgctgtcccaggtagaggtgcgagtataacttggagaatgtgaagtcaaactgattctgtgattctttggtcatctggctcctagcttagctcttgattcactaactatatcatggagtgtgctgtgtgccctctttctcactccatagctacctccaccctggggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctgcaggaccaccaccctacggtcacgaccacgagatggaatactgtgcagacttgcctcctccatactcccccaccccacagggtccagcacagcgttctccaccccctccttatcctggaaacgcaaggaaataatctatctcccagaacagaacatgtgccaatgggcgatcttgcctggaataaaatgcctctactcagaaacaggcaggaaagaattgctccaaggaatactttttggggtcagataatgtgtcaggtggaatatccctgctaggagatataggatttctactctgctcaaagctgaccccatctggagtattaatgtttggttctatggaaccacattttaagagatctgctgatccacctaagcacattcagggaagagtaatgtaattgacaaaatatctgataatcatgttgtttaagggctaggtgaagaaagtttcagtattgatcctg

SEQ ID NO: 1761 - DNA, 4158 bp, Homo sapiens
gttccccctcctcttgcagcacctcggcaggttcaaactcttctccgggagcgtggcggcgatcgcgaggtcacgtgatgagcatcctgctgcccaacatggcggagttcgacaccatctcggaactggaggaggaggaggaagaagaagcggcaacgtcgtcgtcgtcgccgtcgtcgtcgtcgtcggtatctgggcccgacgatgacgaggaggatgaggaggaagaggaggaagaggaggaggaggaagaagaggaggaggaggaagaggaggaggaagcgccgcccccgcctcgggtagtgagcgaggagcatctgcggagatatgctcccgaccctgtattagtgcggggtgccggccacatcactgtgtttggcttgagcaacaagtttgatactgaatttccctccgttctaacagggaaggtggccccagaagaatttaaaaccagcattggccgtgtgaatgcatgtttgaaaaaggctctcccggtcaatgtgaaatggctgctgtgtggttgtctctgctgctgttgcacactgggttgcagcctatggcctgttatttgtctcaacaaaagaaccagaagatcaattcagaagttaatagaatgggaaaataacagattatatcacaagcttgctttgcactggaagttgactaagaggaaatgtgaaactagcaatatgatggagtatgtaatactaatagaattcttaccaaaatatcccatattccgacctgactgaggagttttatccagtcacttctgtgttacctgtcatttcctacccttagtgccttgtagatttggaatgaagatggtctcctttgctgtgttcaacttattctttataatggtagaatattcttctcgctcttttgtgttggtttatgaagaaaatttgcacatcttttttgtctttcaatgaggcttgtgttttgcactctcaattttaaatacacacacatgcgtgtgtgcatatacatatatagatagttgccattaaagataaatcatcagtgttggtgtttaaaaaacaaaaacttgttctgagcatgctgccttataattttcatactcattgtttctaaactcgcatcatttttctaggctacttgatgctctgtaatcccttactggacaaacttaaataagcttttggtagcttttagaaatggttttactctgcttttaaaggacatgcttttaaaggacatgcaattaatggcactggttttgtcctgcactttgctttatcacttatgttagtggataaaatatttaaactcctaaagacttgtaaatattgcctctttgcataatgtaaaatgtggtatgccatggtttacataatgtaacattactcttattgtattgccaacaattttacatagattttaatatgaatgaagtttgcaagcatccctttgaatgtagaaactgctaacatgctgttttatggcaaggccataatgagtatgttaagaatttcaggtgtagggcaaggttgccctttgtaacaagtggactaaaattgaaattattatctcagatattctgtattgcacctgaaaccatgacctttatttttccatttcgtttaataatttccattttgttgtctactccttcccacaaaaaaactatttgacatctgacacatttcacagtctcactatcctgcatttattagccttttcttcctttgaaaatacacacaattatgacttttaaggagtattttgagatttcagacatcttcagaaggtatctagaccctcttgaaagccactaacacctttctgcagttctgatattctagtttgagaaagagagagaactatttgagaagctgtagctaaagagtatatagcagctgattcataattgaaaaaaaattctcaattctgtttttgatgatcctttataaaacattaatgaggaaagacaagtgtttagacaaaagtattttagtttataaattcagcacatatgtaacatttatttggtccatatttctctatttttcttcacaattaaaatgattgctagcaccacacaactagaatttgaaaattcagtataatgaaagctttatatcacattaattcaactgcaaatgtatgcctgtttgtaggcattatttgtaattcatagtgctaaaaataaaagtgtctagggctcagtaatattttgtcatcttactcttactgcttttagtaaaccttttaggcaagattcatctcagtgaagtgaacaatcatttcttcatagaaggtcaagcctttttaagccactcttaaaatttatgcctaatttgaaatccacagtccttgaccagtttaaaaaagagaggaaaaagaagacactattttatatgtgattataattgtttgcacaaacacttttccaccttcctctgtgccccattacctctgtgccactcagtcaccccaaatctctaacctttagtaatgtgtatgcctgcaaatattatgtgtttgcctgctgcaaaattgaaggtgtatttttatagacaaggtagaagcctctgaaaatgtataccaaatgtcttgttttgtagctaaggtcgggaaaaattgtatctgaggtttatgttccagctaatgttatcaaatttatgcttcaaactgtgatattttaataccaaaatcgattttcagcataatacaaaatatctcattttcactgatagaaaattgcttttaagtgttgatccttagaaatcttatttttttctataaccttagaatttgatcatatgatggtcataggaactttttctgccatgtataaatcacacttggttttgctcaaagaacagcatgaagtggtgaattgtttccatgaaacaattattgagaatgggaatacagtatatctggaaatgacacagtataatacaagttacagtagcatttgtcacaaaaaccacttgtcagcatgtgtaaacttaattttaaagcctattctaatcactcgagtttattattttattgttcgctatgctggttgactcatcttagtttcttcaactacccaaaaaaataccaatttttttcctctcttgtatgactactttttcaaactgttttcctttgcagggggctgattagcaattgagtattttgtaatgtttgggcggggttgctttgttttcagtgaaattggttgcagtgaatgctaaaatgacacagcacactggtgattaattcctcccccatggagccttttttctgttatgcttaggatagaacatacttgtaattttccattaggttagtaacatacttttgtgaaagttgtttttagactgaagaaagtaattttgaatttctttgttacataatattcctttatgaaacttgtgatagtttccagagcaaaacatgtatttgccaaagtatataaatctcacaaggctttaagattacaagctaaaattgttttttaaaattaatgttccaatgtttctcatttggcccaagattctggcttcataaatttgtccaactggctatttttaagcttgtcctaaaagccaataacatgtttattcctaataactaatatgggcaagtgttatttacagatttattaactccatcccagatatgtctccactctttgttccctcctaatgctaatttaggaaagagaccactgtagtaaaactttagaagaagatggagaagtgccttgtctttttagaacaaagataacacattacgtgtaaggaagcataataaatgaattggtagatgattagattagaaatcatccttttcaactaggtctaagaatactttactagtgtattatcttttatttattatgtaaagcttctttccttccttttccccaatcatgatatattagtgacaaaatattacagaaccggactatcagtcacttaaaaaaacagtataattctaatgctagtaaacatgtaatttaatttagttctggaaggacagttgtctttgattaaagccccaccaaaacccatttaagtatttaatgtacatactattcatattattatggcctgtaaacactaatatctgagcaatcaaactgttttatctaccatttttgatgaaatttgaataaagtttaaaaacgtgtaa

SEQ ID NO: 1762 - DNA, 3041 bp, Homo sapiens
aactcttctccgggagcgtggcggcgatcgcgaggtcacgtgatgagcatcctgctgcccaacatggcggagttcgacaccatctcggaactggaggaggaggaggaagaagaagcggcaacgtcgtcgtcgtcgccgtcgtcgtcgtcgtcggtatctgggcccgacgatgacgaggaggatgaggaggaagaggaggaagaggaggaggaggaagaagaggaggaggaggaagaggaggaggaagcgccgcccccgcctcgggtagtgagcgaggagcatctgcggagatatgctcccgaccctgtattagtgcggggtgccggccacatcactgtgtttggcttgagcaacaagtttgatactgaatttccctccgttctaacagggaaggtggccccagaagaatttaaaaccagcattggccgtgtgaatgcatgtttgaaaaaggctctcccggtcaatgtgaaatggctgctgtgtggttgtctctgctgctgttgcacactgggttgcagcctatggcctgttatttgtctcaacaaaagaaccagaagatcaattcagaagttaatagaatgggaaaataacagattatatcacaaggtaatactaatagaattcttaccaaaatatcccatattccgacctgactgaggagttttatccagtcacttctgtgttacctgtcatttcctacccttagtgccttgtagatttggaatgaagatggtctcctttgctgtgttcaacttattctttataatggtagaatattcttctcgctcttttgtgttggtttatgaagaaaatttgcacatcttttttgtctttcaatgaggcttgtgttttgcactctcaattttaaatacacacacatgcgtgtgtgcatatacatatatagatagttgccattaaagataaatcatcagtgttggtgtttaaaaaacaaaaacttgttctgagcatgctgccttataattttcatactcattgtttctaaactcgcatcatttttctaggctacttgatgctctgtaatcccttactggacaaacttaaataagcttttggtagcttttagaaatggttttactctgcttttaaaggacatgcttttaaaggacatgcaattaatggcactggttttgtcctgcactttgctttatcacttatgttagtggataaaatatttaaactcctaaagacttgtaaatattgcctctttgcataatgtaaaatgtggtatgccatggtttacataatgtaacattactcttattgtattgccaacaattttacatagattttaatatgaatgaagtttgcaagcatccctttgaatgtagaaactgctaacatgctgttttatggcaaggccataatgagtatgttaagaatttcaggtgtagggcaaggttgccctttgtaacaagtggactaaaattgaaattattatctcagatattctgtattgcacctgaaaccatgacctttatttttccatttcgtttaataatttccattttgttgtctactccttcccacaaaaaaactatttgacatctgacacatttcacagtctcactatcctgcatttattagccttttcttcctttgaaaatacacacaattatgacttttaaggagtattttgagatttcagacatcttcagaaggtatctagaccctcttgaaagccactaacacctttctgcagttctgatattctagtttgagaaagagagagaactatttgagaagctgtagctaaagagtatatagcagctgattcataattgaaaaaaaattctcaattctgtttttgatgatcctttataaaacattaatgaggaaagacaagtgtttagacaaaagtattttagtttataaattcagcacatatgtaacatttatttggtccatatttctctatttttcttcacaattaaaatgattgctagcaccacacaactagaatttgaaaattcagtataatgaaagctttatatcacattaattcaactgcaaatgtatgcctgtttgtaggcattatttgtaattcatagtgctaaaaataaaagtgtctagggctcagtaatattttgtcatcttactcttactgcttttagtaaaccttttaggcaagattcatctcagtgaagtgaacaatcatttcttcatagaaggtcaagcctttttaagccactcttaaaatttatgcctaatttgaaatccacagtccttgaccagtttaaaaaagagaggaaaaagaagacactattttatatgtgattataattgtttgcacaaacacttttccaccttcctctgtgccccattacctctgtgccactcagtcaccccaaatctctaacctttagtaatgtgtatgcctgcaaatattatgtgtttgcctgctgcaaaattgaaggtgtatttttatagacaaggtagaagcctctgaaaatgtataccaaatgtcttgttttgtagctaaggtcgggaaaaattgtatctgaggtttatgttccagctaatgttatcaaatttatgcttcaaactgtgatattttaataccaaaatcgattttcagcataatacaaaatatctcattttcactgatagaaaattgcttttaagtgttgatccttagaaatcttatttttttctataaccttagaatttgatcatatgatggtcataggaactttttctgccatgtataaatcacacttggttttgctcaaagaacagcatgaagtggtgaattgtttccatgaaacaattattgagaatgggaatacagtatatctggaaatgacacagtataatacaagttacagtagcatttgtcacaaaaaccacttgtcagcatgtgtaaacttaattttaaagcctattctaatcactcgagtttattattttattgttcgctatgctggttgactcatcttagtttcttcaactacccaaaaaaataccaatttttttcctctcttgtatgactactttttcaaactgttttcctttgcaggggg

SEQ ID NO: 1763 - DNA, 4441 bp, Homo sapiens
tagtgaaaaaaaaatgtctttaagtcccttttgtatgttattagtatagccacttagctcttttttgattattgtttgcatggtatcttttttcaccctttaactttcattgtatctctgaatctaaagtgtgtttcttgtaaacagcatatagtgggatcatgtttcttatctgtcctgctggtctctgccgtgaatctaaagtgtgtttcttgtaaacagcatatagtaggatagtgtttctcatctgtctttctggtctctgctctgaatcaaaagtgtgtttcttgtagacagcacatagtgggatcatgtttttcatctgtcctgctggtctctgctgtttgagagggatgtttaatccatttacattcagtgtgattactgagaaagttggatttgtatctgccatttctaaatttgtttactatattgtcttttttgtctttcttcctttatttctccattacttttttgtgttaaatggacatttaattctcttgtaacattgtaatttccttgtctgttttactgggtttttttaaaagtaactttcttagcagctgctctgagtattacagtaacaacgtaaaaccaatcaagtgttcagatgaacttaatataatgtacaaaaaccttcacttcaagtagctttgtttcctctcagcttcttggtgctgtatttgtcatataaatgctaccttttagattgtaagtccgtcagcagtcttgtaattattgctttatgcagttgtcttttaaatcacatagaagaagaaaagatgtacaaacagaaatgagtttctgctgtctctgttgctggctttgcagttgtcttttttggtgctctttgtgtggatttgagtgtggtgtcttggacttcagcctcaagtatttcttgtaggacagatcttctagcaatgaattctctttgtttttgtttatctgagaatgttgtaatttttccttctcttctgaagaataattgtgctggatatggctgacttggttggccctctttttctttcagtcctctatagatgtcattccactgcctctggcatctgtggtttccatggcgggagcaccgcaccatgtctcagtctctttttagcttctgactgtttgactgtggtgtgtctaattgtggatctttcagtgtgtcctacctgcagttctttgagcttcttggatatagaggttaatatttcttgtagtctgattgtttacatcttctcttcacttattgatcttctgcctagttatattgatattgaatgtgggtattgaatccttcggttttgtcagcttcatgttcagccagtgactggacaggggacccctttaagtgctttgcaccagtaactctcatggttctgctgacacacagttgatgtgtggtgagtatgccttcagcgctccattgtggttctgcaaatttgggaaattttaggttgtcgtttctcgaaatattttatgtccatgttctcttcccccacttggactccagctacgtgtgttgatgtggagctgggcacagccttggaggcctccttgactttcctttattccggaattttttcttcttctcagaatgggtcatctcagttgacctatcttcaaggtcacagatgcttttgccaaacaaaacctgatgtcaagctgctctagtgaatttttcatttcagttattgtacttttctactccaaacttccatttggctctctcctataatttctgtatctttactcatattctttgtttagtgaaacattctcatactttaattctgtagacacagtttcctttagttatttgaacatatgtgtagaagctgatttaaagtacttgtctaagccgggcgtggtggtgtgcacctgtaatcccagctacttgggaggcagaggcaggagaattgcttgaacccgggaggcagaggttgcagtgagccaggatcaagccattgtactccagcctgggccacagagcgagacgctttcaaaactagatagatagatagattagatagatagatagatagatagatagatagatagatagataggataagataagatagataggtgacttgtctactaagttcaacatcagggcttattcaggggaagttcctattgatgaccttttttcccatgtcagagccaaggaaataacatactctttctttgtggtctcatatatatgtattttttgaagactggacactttaataatgtgctgtgcaactctggaaatcagataccctctccacgagtttattgttgttctgttgctgttaccttttgtttagtgtgtgttctggactaatttgaagtgtccacctcatcagcttcatgttcagccagtgactggacagaggacccctttaagtgctttgcaccagtaactctcacggttctgccgacacgcagttgatgcatggtgagtgtgccttcagcgctccatcgcggttctgctgacacgcagttgatatgtggtcagtgctccagcaggcagctgccaactgtgcctttgccttcacttcttacttgcacacagccacaaagccagccagaggtgagggccagggcagctcaggttcctctcgggcacacacacagctctgtgcctgtgtgggcacagccttccatgcctccaggagtgtggcagagcttctcagcggccactgtgggcatctcgttcctcagatcttcctttcatgagttatgtagttgaattatcaatctttcttggcttctaagttttgtgttctacttagaatgctcttcccccttaaagattatatttgaaatgttttccatgttttcttctagtacttttatgggtttcattttcatattgaaatcattgatctacttctagtttttgatacaaaatgtgagccaggaaacccagtttttaaatttcaaatagctgtccaggtgtccctgcacctcttatgcatgagccctcgctttgtgccaatgtggagtgcccgcctgctcacacgtgcccatgtggagtgcccgcctgctcatgtgcccatgtggagtgcccgcctgctcacacatgtcgatgcggagtgcccgcctgctcacacatgcccatgtggagtgcccgcctgctcacacgtgcccatgtggagtgcccgcctgctcacacacgtgtccatgtggagtgcccacctgctcatgtgcccatgtggagtgcccacctgctcacatgtgccgatgtggagtgccacctgctcacacacgtgcccatgtggagtgcccgcctgctcacgtgcccatgtggagtgcccgcctgctcacacgtgccgatgcggagtgcccgcctgctcacacgtgcccatgcggagtgcccgcctgctcacacgtgcccatgcggagtgcccgcctgctcacacgtgcccatgcggagtgcccgcctgctcacacgtgccgacgtggagtgcccgcctgctcacacgtgcccatgtggagtgcccgcctgctcacacgtgccaacgtggagtgcccgcctgatcacacgtgcccatgtggagtgctcgcctgctcacacgtgccgatgtggagtgcctgcctgctcacacgtgcccatgtggagtgttcgcctgctcacacgtgccgatgcggagtgcccgcctgctcacacgtgccgatgcggagtgcccgcctgctcacacgtgcccatgtggagtgcccgcctgctcacgtgccgatgtggagtgcccgcctgctcacacgtgcccatgtggagtgcccgcctgctcacgtgccgatgtggggtgcccgcctgctcacatgtgccgatgtggagtgcccgcctgctcacacgtgcccatgtggagtgcccgcctgctcacacgtgccgacgtggagtgcccgcctgctcacgtgcccatatggagtgcccgcctgctcacacgtgccattgtggagtgcccgcctgctcacacacatgccgatgtggagtgcccgcctgctcacacgtgcccatgtggagtgcccgcctgctcacacgtgcccatgtggagtgcccgcctgctcacacacgtgcccatgtggagtgcccgcctgctcacacgtgcccatgtggagtgcctgcctgctcacacacgtgcccatgtggagtgcccgcctgctcacacaaagccctggcatggtggttctgtaggtttcctgtcctgccggccgagtcagacgctgttaccgtacattctactcatggtggctttttaatacgtttttatgtcaaggatcccttttatatttctctgcacctcgagataacgtaggaatattagggatgagatggaagaggagagggtgtttttgtaaaattgaattcaggactgatttgttagcctggtgcttttcgtatcagaccttttaatgaattttcatggatgctgattaaaagacaaacctgtgactc

SEQ ID NO: 1764 - DNA, 1167 bp, Homo sapiens
gccaatgtggagtgcccgcctgctcacacgtgcccatgtggagtgcccgcctgctcatgtgcccatgtggagtgcccgcctgctcacacatgtcgatgcggagtgcccgcctgctcacacatgcccatgtggagtgcccgcctgctcacacgtgcccatgtggagtgcccgcctgctcacacacgtgtccatgtggagtgcccacctgctcatgtgcccatgtggagtgcccacctgctcacatgtgccgatgtggagtgccacctgctcacacacgtgcccatgtggagtgcccgcctgctcacacgtgccgatgcggagtgcccgcctgctcacacgtgcccatgcggagtgcccgcctgctcacacgtgcccatgcggagtgcccgcctgctcacacgtgcccatgcggagtgcccgcctgctcacacgtgccgacgtggagtgcccgcctgctcacacgtgcccatgtggagtgcccgcctgctcacacgtgccgatgcggagtgcccgcctgctcacacgtgccgatgcggagtgcccgcctgctcacacgtgcccatgtggagtgcccgcctgctcacgtgccgatgtggagtgcccgcctgctcacacgtgcccatgtggagtgcccgcctgctcacgtgccgatgtggggtgcccgcctgctcacatgtgccgatgtggagtgcccgcctgctcacacgtgcccatgtggagtgcccgcctgctcacacgtgccgacgtggagtgcccgcctgctcacgtgcccatatggagtgcccgcctgctcacacgtgccattgtggagtgcccgcctgctcacacacatgccgatgtggagtgcccgcctgctcacacgtgcccatgtggagtgcccgcctgctcacacgtgcccatgtggagtgcccgcctgctcacacacgtgcccatgtggagtgcccgcctgctcacacgtgcccatgtggagtgcctgcctgctcacacacgtgcccatgtggagtgcccgcctgctcacacaaagccctggcatggtggttctgtaggtttcctgtcctgccggccgagtcagacgctgttaccgtacattctactcatggtggctttttaatacgtttttatgtcaaggatcccttttatatttctctgcacctcgagataacgtag

SEQ ID NO: 1765 - DNA, 4365 bp, Homo sapiens
ccatttctgagttggggccagctccccacccccaagaggccccacattccgggccagcagcccagaaagtccctccccgcaggcggagacagccccaagaagtcgacgccccggtcccgccgcccggccactacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagcgggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtttgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatatgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattgttctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttggaagctc

SEQ ID NO: 1766 - DNA, 3540 bp, Homo sapiens
actacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagcgggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtttgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatatgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaa

SEQ ID NO: 1767 - DNA, 1493 bp, Homo sapiens
gttactgaagccctctgcgagcttggatgctggacgagggagaggccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagcgggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctac

SEQ ID NO: 1768 - DNA, 2998 bp, Homo sapiens
ggctttctcttcccgctctatggccagtctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccatctccataggggtaggcatttcactggtttatgaagctcgagtttcattaaatatgttaagaatc

SEQ ID NO: 1769 - DNA, 3205 bp, Homo sapiens
tctatggccagtctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaagaggaagagaaagcagaagtctcagggctggagacagctgaggggcatcagctggttcaaggtgtggagtgtgggcagtggagtgaaggcctggttacctctccagtgaagattagccccatagagcttactctatggggaagaacttttctgactccttcctgtctagggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccatctccataggggtaggcatttcactggtttatgaagctcgagtttcattaaatatgttaagaatcaaagctgtctttgttcaggctgctataacaaaaatataatagcctgggtggctt

SEQ ID NO: 1770 - DNA, 1094 bp, Homo sapiens
gttacctctccagtgaagattagccccatagagcttactctatggggaagaacttttctgactccttcctgtctagggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctg

SEQ ID NO: 1771 - DNA, 4094 bp, Homo sapiens
agggagtggacccgaattcctgtaccagctcggccacttaccttggctaagtcattttcttgttttgggccccagtgtcacagtgtttttgatttgtaagatgagggtttagggcttgtatcctaaatctggtcctcaagattcttgaagtcccccagtccatcggggagggagagcaacaaactgattttctaccccttcatttatttgtagttctaaattataaaagtaacactgcaagagtttggagtagagcctttttctttttctttcttttttttttttctgagacagagtctcactctgtcgcccaggctggaatgcagtggcacgatctcggctcactgcaacctccgcctcccgggttcaagcgattcccctgcctcagcctcccaagtagctgggattacaggcgcccgctaccgcgcccggctaatttttgtatttttagtagagacggggtttctccatgttggtcaggctggtctcgaactcctgacctcatgtgatccgcccgcctcggcttcccaaagtgctgggattacaggcgtgagctaccgcgcccagcctgcgtagagcctttttctaagactaagggctggatgggaactagcatttcttacccctggatgtgacctgttttagctcagccgggagaatcctttttcgcaagaagttaataatatcttgtgacgtgaaaattatgtgaaactcagacttcagtgtccataaataaatattactggaacacagccgtggtgctcatttgttaagatgtttatgtggctgctcttgcatgggcagagttgatgacatagttgtgacagaccatgtgctctacaaagcctagaatatttactacctggacctttacagaagagcttgctgactgctcccttagaatggggctctgcaaagtgagcacaccctgggatcacagcccagcctgcccttagaacaaatgagaggatattttcaagcatttgcattgcagttttcacggtttttttgttttgttttgtttttgagacagagtctagctctgtcgcccaggctagagtgcagtggtgcgatctcggctcacttcagccttctcctgggctcaagccatcctcccacctcagcctcctgagtagctgagactacaggtggatgccatcacgcccagctaatttttttttttttttaagagatgagggctcactgttgctcaggctggtctggaactcctgggtatttatttatagacagagtctatctctgttgcacaggctgcagtgcagtggcgtgatcttggctcactgcaacctctgcctcctgggttcaagcaattctcgtgcctcagcttcccgagtaccttggactacaagcgcatgccaccgtgcctggctaatttttgtatttttagtagagacgggattttgccatgttggccaggctggtctcgaacccctgacttcaggtaacccacctgcctgggcctcccaaagtgctgggattacaggcatgaatcactgtgctggtccttcactgcattcttccttttctcctgctttgctctatttcaggaagtaggagggcttatctgtgtattgtgagcagggcaatataactttgcagctctctgtcaggaaagtgtgcccagggtctattctaagtctgtcacagagcagtaaaccaggaccttttctagggtgtggctacagatcctttcggactgcatttactttttcctcttacaaagaaaaaaaaaacagttgtggaagtagatattgtcagatgagtgagcctgctgatcaagatctcttacatttcactgagggatggagagtgttttaggtgaatatctggtgatctgaaacgtcctctgcccttggaggaattgaggaggcagttctgaggctgggtagcaaatctctgagttaagtagttgagtcacaaatcttctaggaggctggtggcatgattttctcctgccagcttcatggaagctttttccctgcagcccttggaccttcttttcttttttttttttttttttgagacagagtctcactctgtcccccaggctggagagcagtggcgcgatctcggctcactgcaacgtccacctccagggttcaagcaattctcctgcctcagcctccctggtagctggaattacaggcgtgcgccaccacacccagcacatttttgcattttcagtagagacgtggtttcaccatgttggccaggctggtctcaaactcctgacctcaggtgatccatccgcgtcggcctcccaaagtgctgggattacaggcttgagccaccgagcctggctggaccttcctttctcagagattactgccaacttgggtcaccttgtgcatctttacctaagtaggtggacccctagcatggggagagctggcatggcatggctgagggccactgagaggcctgggcaggcacaaggaacatgagctgcatgttagtagttaggatgaagtgcatgacagcaatgactaagaattctatgtatatatatatatttttagatggagtctcgctcagtcgccaggctggagtgcagtggcgtgatcgcagctcactgcaacctccacctcccgggttcaagcgattttcctgcctcagcctaccgagtagctagctgggactaaaggcgcgcgccaccatgcccagctaattttttatttttagtagagatgggggcgggggttcaccatattggccaggatggtctcgatctcttgaccttatgatctgcccgcctcggcctcccaaagtgctaggattacaggtgtgagccacctcacccagcctttttttttttttttttttgagatgaagtttcgctctcattgctcagggtggagtgcaatggcacaatcttggctcattgcaacctctgcctccctggttcaagcaattctcctgcctcagcctcctgagtagctgggattgattacaggcgcccaccaccactcctggctaattttgtatttttagtagagaccggggtttcaccatgttgatcagtctggtctcgaactcctgacctcaggtgatccacctgcctcagcctcccaaagtgcaggattacaggcataagccatcgcgcccagcgaagaattctaatacttgacttctacagtgtgctacattcattttctcacttgatctgacaacctgtggtcaaggaagcagcgtgggccttgaagctaaacacacaggatttggaactccccacccactctcactgggtcctcatgctaattacttatctctctcagccttagtttcctcacggaataatatgcctcccagggttaagaggagtaaatgggatcttgtgtgtaaggctctggtgctcgtagctggtgttcgttattcttactgttcaagtattcttactgccacgcctttcttgcaggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtt

SEQ ID NO: 1772 - DNA, 540 bp, Homo sapiens
atgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgca

SEQ ID NO: 1773 - DNA, 779 bp, Homo sapiens
tctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaagaggaagagaaagcagaagtctcagggctggagacagctgaggggcatcagctggttcaaggtgtggagtgtgggcagtggagtgaaggcctggttacctctccagtgaagattagccccatagagcttactctatggggaagaacttttctgactccttcctgtctagggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactccc

SEQ ID NO: 1774 - DNA, 650 bp, Homo sapiens
ggctggagacagctgaggggcatcagctggttcaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgc

SEQ ID NO: 1775 - DNA, 573 bp, Homo sapiens
gctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttagggggtgtggctacagatcctttcggactgcatttactttttcctcttacaaagaaaaaaaaaacagttgtggaagtagatattgtcagatgagtgagcctgctgatcaagatctcttacatttcactgagggatggagagtgttttaggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatgg

SEQ ID NO: 1776 - DNA, 1651 bp, Homo sapiens
cgccctccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaagggt

SEQ ID NO: 1777 - DNA, 680 bp, Homo sapiens
ccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaaggtatccttcccatttctggacatcccactatcccctcatcgtcaaaatcaaagccttgcccctttgtgaattctggcttcattgaaatcaaccttgcctcacactgccaactcggaagtctgagtgcacagacacagtga

SEQ ID NO: 1778 - DNA, 5009 bp, Homo sapiens
tgttcgggcagctggagtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccaaaacaggtcccctgatggaggatagaagtgaaggaggccgggcgcggtgggtcatgcctgaaatcccagcactttgggaggccgacgcgggtggatcacttgaggtcttttctcctggcaccctgtattcatggccttggcgttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaaggtgatggagagcctgatcctgaagcctctacttgatgagagacagagttttgggtggtgatagtgatgtgctggtggtcatttcttgcttgtgtgcctgatgaaaaactgggttcctgtaagttatgaatggcatccagggatatttgggttacttttaagaaagcagtgtgatgtagtggagagagcccatgggtcttatttatgggatatggtcctcttaggctctgttgtacaaccttaggtacattccatatcttaagaccactgtttcttcatctgtgaaatgtttctaaacaatctctaagtcccttccttctctaatatacagcgtctgtcaggtcgatgtctcagaacactctcccagctgtggaccacgtggaccacttagcagactcagggggtagttctttactctccctttactaccctggagggacagctctgcccttgaggcccttcagaaatttgtgctgatttggtccctgtgccagggcacagggggtcaggcactgtggaaagaagggactcaggtgagggtcttctggactctaagacggtaaaggcactaaagtcactttaaagcttttggagaagcaggagggcattggcttaaccaagccgaaggctgctggctgggctgcctagcccagctaagatcttccttcagcccacctcaggatccgggcttgagggctgcagggcctgcgtgcgctccctcccccgaaatcacttctcagggcaaaggagccccaggcatctcatgctttgcccttcttagggctcaggttcttgccttagcacatagcttctgggagcttttttgaagcatttcataagggccaaggaagtggggcagggcttttctgatccaaagaaaacaaagtttctctggttacccctcttcccttgttatctaagctttcctcagttgtcatctcttcccagctctttggtccaagagggggctgagtttggtgccagctggcaaatgagggctggactctcttccctccagagaccaccccgctccttgctgcagctgaaagtagttccccaggctgccctcggtggtgaggactggatgctagactgctgagctgtggtctgggctcagttgagaagataggatctccctagatcatggcaaggcctgacaacagctgagccaggaaagtgctgctgaggcaagtcgacatagctcacagggaactctgggaagcctgggatgtaggcgctggagctccagttcccaggagcaggggcaggtgttcctagatgttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccagctgtcgcctttctgaccagcaggcctggagggcaggggcacagagcagagaggagggcactggtggtctcctgcttagcctggtctgactgcagtgtagggaataggtcaccaggaggagcccttcatcctggcaggccggattgtggagggacttccctccccctcttttccatttctccctccatcaccacctgccctcacatcctggggcagcagctggacagccattagacctcagtgccagggcactcttcctccagctgggatctcagtggctcccagctgcatgggctcctgcttgtgtgttccctcctccgccatcctctgttccccgcacctcccttattctgctcatgtctggggtattcacttggctcctcagcaaggaagcaaacgccttggaggagaagcacatggttgcccttttgtccttgctccctggctagggaaagctgctagtggtcagcctgttttgcctttttttaaaaaaaaaaaaaaagccagggcagggtgcttagattttaaaaatttgcgtgtcatttgcacaaattttcatatcaagctaagtcctgattccaaatttgattatattccaaatttgattatattccaaatttgattatattcagattcaaccttgaggacattagaaatatagatggcttctgtatccaaatctgaatggaaatgagattacccttctgggttcagatacccctcccaagcccccgtcttttctgtaaccacccctcctctgagccccatcatggctggggttggtatggaatgggagcagctctgtatctggggaagtcctccagcctcaccttcttggctcttaagtggtaggctgttaccacttgccagcctgggcctcctctctccccaccctttcacaaggcaggctgcccttccgcactcactggcccatcccttctttctcatcgtcccacccttccacccccgtgcatggctgctgtaggtctggtttttttggtttttgttttttttaagacggagtctcactctgccgccaggctggagtgcagtggcagaatcttggctcactgcaacctctgcctcccaggttcaagcgattctcctgcctcagcctcccgagtagctgggactacaggcacgtgccaccatatccagctaatttttgtatttttagtagagatggggtttcaccatgttggccaggatctcttgacctcgtgatctgcccgcctcggcctcccaaagtgctgtgattacaggcgtgagccaccgtgcctagccaggtcttgttttgaaaacctcactgtgggagattcaggcatcctccctaagccagctggccgctgtgctaaagcctgttcagagttaataataatcattagctgaatggtgctggggcctttcagcttcagatctctaagcacttgcaggctgagtcagtcagccctcaccttccccctccttcctgggctgcagagtgtaacagaatgggaaggcactgtgggaaggaagtcaggaatcttgctgctagccacgccttgcagtgacttctcgtctgggagtgggcactgagtcctctcagtaaactaataagacttgcacctgacaaaggtcaagatatgtagggaacacagtgtatgctaggctgagacctatggtggtggcaggggtggctgttgagcctgaacttccagtactcctgcccttccttctgtttacctggcttggcctacagggggcacccctggtcttgatgcctcaagcccagcatttctgggtcccctctgcaagctcagagagcagggaggcttctggtagtgctcttgatgctcctgtgtctggttggcacaaagatcctgtgtaacatgaaatgaaaggtgcatcagcttgggggctgggaaacctgcagtatgggtttactccgtccctatcactggtgtggctgtgggcaaaccacttattgcctgacctacctcacagggatgttgtgagggtttgatgagagaatgaatgttaataggaattggaaaattcaaagcattaaacacatgtaaacaggtgg

SEQ ID NO: 1779 - DNA, 1085 bp, Homo sapiens
agtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccaaaacaggtcccctgatggaggatagaagtgaaggaggccgggcgcggtgggtcatgcctgaaatcccagcactttgggaggccgacgcgggtggatcacttgagttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaaggtgatggagagcctgatcctgaagcctctacttgatgagagacagagttttgggtggtgatagtgatgtgctggtggtcatttcttgcttgtgtgcctgatg

SEQ ID NO: 1780 - DNA, 620 bp, Homo sapiens
ctctcctgcagccgccaccgcctccgcgatcgcaaacccggaagacgtgttcgggcagctggagtgtacgggcccgcgggccacggccatgcagcccctggagttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacg

SEQ ID NO: 1781 - DNA, 3326 bp, Homo sapiens
gttcgggcagctggagtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccagtcttttctcctggcaccctgtattcatggccttggcgttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaaggtgatggagagcctgatcctgaagcctctacttgatgagagacagagttttgggtggtgatagtgatgtgctggtggtcatttcttgcttgtgtgcctgatgaaaaactgggttcctgtaagttatgaatggcatccagggatatttgggttacttttaagaaagcagtgtgatgtagtggagagagcccatgggtcttatttatgggatatggtcctcttaggctctgttgtacaaccttaggtacattccatatcttaagaccactgtttcttcatctgtgaaatgtttctaaacaatctctaagtcccttccttctctaatatacagcgtctgtcaggtcgatgtctcagaacactctcccagctgtggaccacgtggaccacttagcagactcagggggtagttctttactctccctttactaccctggagggacagctctgcccttgaggcccttcagaaatttgtgctgatttggtccctgtgccagggcacagggggtcaggcactgtggaaagaagggactcaggtgagggtcttctggactctaagacggtaaaggcactaaagtcactttaaagcttttggagaagcaggagggcattggcttaaccaagccgaaggctgctggctgggctgcctagcccagctaagatcttccttcagcccacctcaggatccgggcttgagggctgcagggcctgcgtgcgctccctcccccgaaatcacttctcagggcaaaggagccccaggcatctcatgctttgcccttcttagggctcaggttcttgccttagcacatagcttctgggagcttttttgaagcatttcataagggccaaggaagtggggcagggcttttctgatccaaagaaaacaaagtttctctggttacccctcttcccttgttatctaagctttcctcagttgtcatctcttcccagctctttggtccaagagggggctgagtttggtgccagctggcaaatgagggctggactctcttccctccagagaccaccccgctccttgctgcagctgaaagtagttccccaggctgccctcggtggtgaggactggatgctagactgctgagctgtggtctgggctcagttgagaagataggatctccctagatcatggcaaggcctgacaacagctgagccaggaaagtgctgctgaggcaagtcgacatagctcacagggaactctgggaagcctgggatgtaggcgctggagctccagttcccaggagcaggggcaggtgttcctagatgttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccagctgtcgcctttctgaccagcaggcctggagggcaggggcacagagcagagaggagggcactggtggtctcctgcttagcctggtctgactgcagtgtagggaataggtcaccaggaggagcccttcatcctggcaggccggattgtggagggacttccctccccctcttttccatttctccctccatcaccacctgccctcacatcctggggcagcagctggacagccattagacctcagtgccagggcactcttcctccagctgggatctcagtggctcccagctgcatgggctcctgcttgtgtgttccctcctccgccatcctctgttccccgcacctcccttattctgctcatgtctggggtattcacttggctcctcagcaaggaagcaaacgccttggaggagaagcacatggttgcccttttgtccttgctccctggctagggaaagctgctagtggtcagcctgttttgccttttttt

SEQ ID NO: 1782 - DNA, 5077 bp, Homo sapiens
gtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccaaaacaggtcccctgatggaggatagaagtgaaggaggccgggcgcggtgggtcatgcctgaaatcccagcactttgggaggccgacgcgggtggatcacttgaggtcttttctcctggcaccctgtattcatggccttggcggatgtatgagagcacctcctttttctcaggcctccaagccagacatgaggcttactggctctctcctatgttcacagttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaaggtgatggagagcctgatcctgaagcctctacttgatgagagacagagttttgggtggtgatagtgatgtgctggtggtcatttcttgcttgtgtgcctgatgaaaaactgggttcctgtaagttatgaatggcatccagggatatttgggttacttttaagaaagcagtgtgatgtagtggagagagcccatgggtcttatttatgggatatggtcctcttaggctctgttgtacaaccttaggtacattccatatcttaagaccactgtttcttcatctgtgaaatgtttctaaacaatctctaagtcccttccttctctaatatacagcgtctgtcaggtcgatgtctcagaacactctcccagctgtggaccacgtggaccacttagcagactcagggggtagttctttactctccctttactaccctggagggacagctctgcccttgaggcccttcagaaatttgtgctgatttggtccctgtgccagggcacagggggtcaggcactgtggaaagaagggactcaggtgagggtcttctggactctaagacggtaaaggcactaaagtcactttaaagcttttggagaagcaggagggcattggcttaaccaagccgaaggctgctggctgggctgcctagcccagctaagatcttccttcagcccacctcaggatccgggcttgagggctgcagggcctgcgtgcgctccctcccccgaaatcacttctcagggcaaaggagccccaggcatctcatgctttgcccttcttagggctcaggttcttgccttagcacatagcttctgggagcttttttgaagcatttcataagggccaaggaagtggggcagggcttttctgatccaaagaaaacaaagtttctctggttacccctcttcccttgttatctaagctttcctcagttgtcatctcttcccagctctttggtccaagagggggctgagtttggtgccagctggcaaatgagggctggactctcttccctccagagaccaccccgctccttgctgcagctgaaagtagttccccaggctgccctcggtggtgaggactggatgctagactgctgagctgtggtctgggctcagttgagaagataggatctccctagatcatggcaaggcctgacaacagctgagccaggaaagtgctgctgaggcaagtcgacatagctcacagggaactctgggaagcctgggatgtaggcgctggagctccagttcccaggagcaggggcaggtgttcctagatgttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccagctgtcgcctttctgaccagcaggcctggagggcaggggcacagagcagagaggagggcactggtggtctcctgcttagcctggtctgactgcagtgtagggaataggtcaccaggaggagcccttcatcctggcaggccggattgtggagggacttccctccccctcttttccatttctccctccatcaccacctgccctcacatcctggggcagcagctggacagccattagacctcagtgccagggcactcttcctccagctgggatctcagtggctcccagctgcatgggctcctgcttgtgtgttccctcctccgccatcctctgttccccgcacctcccttattctgctcatgtctggggtattcacttggctcctcagcaaggaagcaaacgccttggaggagaagcacatggttgcccttttgtccttgctccctggctagggaaagctgctagtggtcagcctgttttgcctttttttaaaaaaaaaaaaaaagccagggcagggtgcttagattttaaaaatttgcgtgtcatttgcacaaattttcatatcaagctaagtcctgattccaaatttgattatattccaaatttgattatattccaaatttgattatattcagattcaaccttgaggacattagaaatatagatggcttctgtatccaaatctgaatggaaatgagattacccttctgggttcagatacccctcccaagcccccgtcttttctgtaaccacccctcctctgagccccatcatggctggggttggtatggaatgggagcagctctgtatctggggaagtcctccagcctcaccttcttggctcttaagtggtaggctgttaccacttgccagcctgggcctcctctctccccaccctttcacaaggcaggctgcccttccgcactcactggcccatcccttctttctcatcgtcccacccttccacccccgtgcatggctgctgtaggtctggtttttttggtttttgttttttttaagacggagtctcactctgccgccaggctggagtgcagtggcagaatcttggctcactgcaacctctgcctcccaggttcaagcgattctcctgcctcagcctcccgagtagctgggactacaggcacgtgccaccatatccagctaatttttgtatttttagtagagatggggtttcaccatgttggccaggatctcttgacctcgtgatctgcccgcctcggcctcccaaagtgctgtgattacaggcgtgagccaccgtgcctagccaggtcttgttttgaaaacctcactgtgggagattcaggcatcctccctaagccagctggccgctgtgctaaagcctgttcagagttaataataatcattagctgaatggtgctggggcctttcagcttcagatctctaagcacttgcaggctgagtcagtcagccctcaccttccccctccttcctgggctgcagagtgtaacagaatgggaaggcactgtgggaaggaagtcaggaatcttgctgctagccacgccttgcagtgacttctcgtctgggagtgggcactgagtcctctcagtaaactaataagacttgcacctgacaaaggtcaagatatgtagggaacacagtgtatgctaggctgagacctatggtggtggcaggggtggctgttgagcctgaacttccagtactcctgcccttccttctgtttacctggcttggcctacagggggcacccctggtcttgatgcctcaagcccagcatttctgggtcccctctgcaagctcagagagcagggaggcttctggtagtgctcttgatgctcctgtgtctggttggcacaaagatcctgtgtaacatgaaatgaaaggtgcatcagcttgggggctgggaaacctgcagtatgggtttactccgtccctatcactggtgtggctgtgggcaaaccacttattgcctgacctacctcacagggatgttgtgagggtttgatgagagaatgaatgttaataggaattggaaaattcaaagcattaaacacatgtaaacaggtggtattatt

SEQ ID NO: 1783 - DNA, 1754 bp, Homo sapiens
tgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttctaaagcacagaaaatggaaagactgttatttgcaaacttgactcttcaattgaattacccaattagtacaggccactgatttgactgacacagtcgataacatgcagcctatccagaaggtgtctgttgggaaagtttaggataaaactttttctttagttcagtcttttcctgtctagttctaaaatgaattgtgtttgattccttagagaagaaatacttcatttgtgctctgattcactgaagtaataacctcagcactttaatagcgtccacaggcatagctgatgctaggccccagattgtgttgcccaggctctttaccatcatcttcggactgtttttgtttcctggttacattttcagtctggcccgctctacataatgggccagtgtcagctccaagtccacatccttattatccatgattcaaaagggagagagagaacttcctttttcagggtccacaaatcaaatctataaaaggactctggtcttcccaggatcacctgcccttgcattggaccagtccctgtggaagaggggatgggggcctgtgatcttggccaggcctgggctatctatctgcactgtcattgctaactcctgtcagaatcacatggatgagtagtgggctgaatcccaaaaggaaaggggtttagagcaagtggaaacaacagatgttcactatagaaagcaagaatgaaaaccatgaagtggttgaagattagccttacagtaattttattctgatcacttaatacagtagagtcaaacaggaatccaagtttccaactttattatttttggcactgaagaattacaaagaactctagcgtctttatacctccgtggttcactggagttaaagcaatcggggcgttgtacagctcacttgagtttttaaaggttctactaaaaagtgagaattccacagcaatatgggtcattgttgcagaatatcacaaaggtctgttgtgtatactccttttcaccaggaaagggacaataatagtttttttcaatgtatatatatataagtgatctaactttttattaataaaagtaaacaactctaaaatgtatattataaagccctgtcatctttgttgagtaatagctttattgagctttatttggagaaatacacataccgtaaaattcacactgaaactta

SEQ ID NO: 1784 - DNA, 571 bp, Homo sapiens
ttgcggcgctgcggcagtccagatcaaaaatggcggcagttggtgtgttctcggtttctcggctgctgggtcggtcccgcccacagctggggcggcctatgtcgagtggcgcccatggagaagagggctcagctcgcatgtggaagaccctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccattactctgcacatggaccagaaaaagtatatgggaccttaagctcaccttctttacttgtatcaaatgatgactggtatactggtctcccatccctttgcttgtggcgggagatggcttaaataaataacttaaacttaaaaaaataaaataaaataa

SEQ ID NO: 1785 - DNA, 419 bp, Homo sapiens
ggtgattggcccagagaggggaggtgaccccaggccccaggaaagggagcgaggacagcgctggttcccggctccccgcaccatcatggctttgcctctgaggcccctgacccggggcttggccagcgctgccaaaggaggccacggaggagcaggagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacgaacacccctgaggccccggacgcccccggacacaataaaggtgtgaagctt

SEQ ID NO: 1786 - DNA, 1657 bp, Homo sapiens
gcggtgcacgacggctcccattggctggggctcgggcgtcctagccaatccggccgcggggtgcgtttctcctgacccgggtgggaccgcaccccgcggactcagaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccggtgctgcccagctcaagccagaagctgactttggccgccatggggacatcaggcaaggtctggagacatttttggttggggcagaggcatgctcctggcatcgagtgggtggagaccagagaagccgctcaacatcctgcaatgcatgggacaggccctgcctagaaacaccagctcagcatggcagcagtgcggaggccaggaaaccctgatcgccagtttctaacgccctcaccatttttatttttatttttattttttttgagacagagtttcgctcctgtcacccaggctggagtacaatgatgcgatctcagctcactgcaacctctgcctcccgggttcaagtgattctcctgcctcagcctcccgagtagctgggattacaggcatgcaccaccacgcccagcttattttgtatttttagtagagacggggtttctccgtgttggtcaggctggtctcaaactcctgacctcaggcaatctgcccacctcagcctcccaaagtgctgggattacaggcgtgagccactgcacccggctcaccactagtttttagccctttttgttgggggtggggtgggggcagaggagaggcggatacagaaacttgtgagaatgtgatgaacgctctgaaccccctataaaaaatgtgcatgtaaatatatactctcaacattt

SEQ ID NO: 1787 - DNA, 2471 bp, Homo sapiens
tcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcattgtaggttttgtttctttgtaaatgaaactaagcttgatcactttagcctttatgttaatattaaagtcaaatgctgtgcagcttcttaaataggtttttttttttttttttttttttttttgggacgaagtctcactttgtcccccaggctggagtgcagtggcaccatctcagctcactgcgacctctgcctcctgagttcaagtgattctcctgtctcagcctcccgagtagccagaactacaggcacatgccatgacgcccagctaattttttttttttttgagacggagtctcactctgttgcccaggctggaatgcaatggcgtgatctcggctcctgcaacctccgcctcccgggttcaagcgattctcctgtctcagccttccaagtagctgggattacaggtgcacgccaccaggcccggctaatttttgtatttttagtagagacggggtttcaccatgttggtcaggctggtctcgagctcctgatctcgtgatccacccaccttggtctcccaaagtgctgggattacaggtgtgagccaccgtgcccggcaatttttgtatttttagtagagacagggtttcaccatattggtcaggctggtttcaaactcacgacctcaggtgatccgcctgccttggcctcccaaagtggtaggattacaggcgtgagccacggcacccagcccttaaatggcttttatgaggtaatgtgaaaggaaaatttgcctttgacctggaagtcaactttatagtaagctgaaattataaataactgatcatggaactattgcagatcacctttgagccaaaaatttggcctggattttggttatgcctactactatgtgcctctcatttgtatttatacctggaattggcattattaactccttttcactcctgcctagaaaacttaaagtgtcaccagacccaagggcggagtggtcctataaaacaaactcgtagcctgtctgaagactagctactagctccttggctgttttggcatattcatcttgattatagctcttggtctttcatcatattagggatgtttatgatgttattaaagaaaatcttgtcaaatgcagtctgttcctagttatctactatcagtcacctgttgtataattataacaatgtttggatttgtggattattattttagtatataacattggattttatgtatgttacctgaagaagagcaatatctgtaccacatatttctttgtttttcttttttgagatgaagtctcactctgttgcccaggctggagtgcagtggtgtgatcttgacacactgcaacctttgcctcccggattcaagtgattctcctgtctcagcctccctagtaactggaattacaggcgcctgccaccatgcctggctaatttttgtatttttagtagagatggggtttcaccatgttggccaacctggtcttgaactcctgacctcaggcgatccacccacctcagcctcccaaagtgctaggcttacaggcatgagacaccgcgcccggcttatatatcattactttcttggctgagagctgtagtctgtggtagttgttttgttttgttttttgttttttttttgtagttttcttgatcgtgatcaattaagcagaaagtagaatttcagtcaggtaacctgtctatattagctaaattatcttttgcttattacatagagtgctagaagtatgctgtcatggcatatgtcctagtttctcatcaaatggaccaaagtcagtgattttatttgaagaggaaaaattgaacgtcattgtaaattaagttgcaagtttagtaaccatattgtaccactgtttgataaatttgaacgctttatggtatttcatatttagaatgttcaaaatagtactgaagtattcaaatacatacaaccctgagcgatattgaagtaaaataaacatgtatttaaggaagtgtcaaccttcaattata

SEQ ID NO: 1788 - DNA, 507 bp, Homo sapiens
ggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaacttta

SEQ ID NO: 1789 - DNA, 533 bp, Homo sapiens
acgagcactggagcttgcgttacttggcctcacctcacctgtgctgtccacgcctggctttgtctcacctgacgcgatatgcctctcctgcgtgggcgctgtcctgcccgccgccactaccgccgcttggccctgctcggcctgcagcccgctccccgcttcgcccactcggggcccccgcgccagcggcccctgtctgccgcggaaatggctgttggacttgtggtgttttttacgaccttcttaacaccagctgcatatgtgctaggcaacctgaagcagttcagaaggaattagatggaagatgatgttgaacagctgttaacgtccaaaaaactttcagaaaaagctgtgtttttgttaacgagcaaaattgcctagttgagttgatgcaaccattgtggtattcactttcctcatgtttatgatgaatattttgcacttttttagtactgtgcattatatagatgtatagtcaaaaatgttctgcttaagtgttaaataaaacggaaacacttattcgtgcttggtaa

SEQ ID NO: 1790 - DNA, 2001 bp, Homo sapiens
gacagacccagcattcctcccagcgcacgccgccgcccgggccgcgctattccgaaattgggtccgccctagcgtggcccccggcctgctcctgcgctcttcgcgggtcgctcacctccgcctcccctcgacacagcccgagcccatccgccccccgggtcgacccgcgtttacctcagggcgaggtccaggcgctcggccccgcggaggcggcggcggccccaccgcaggtcctaggtcccagtcactctgccgccaagttccccaacacggactccgtgcgctttgaggtgttacgggggcgctggagcactggcttcgctggccctgccaggaggcggcggcgaagcagggagcgacccggtatgcgtttctctgcccggcctgcggccctgcagcatccactcctcgcctctgctggcctctgccctcgctcgctgcgttcacccgagctcacccgagcccaccggagccgacagtggcgcgctaagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatgtgg

SEQ ID NO: 1791 - DNA, 1934 bp, Homo sapiens
agcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatgtgg

SEQ ID NO: 1792 - DNA, 1794 bp, Homo sapiens
attccgaaattgggtccgccctagcgtggcccccggcctgctcctgcgctcttcgcgggtcgctcacctccgcctcccctcgacacagcccgagcccatccgccccccgggtcgacccgcgtttacctcagggcgaggtccaggcgctcggccccgcggaggcggcggcggccccaccgcaggtcctaggtcccagtcactctgccgccaagttccccaacacggactccgtgcgctttgaggtgttacgggggcgctggagcactggcttcgctggccctgccaggaggcggcggcgaagcagggagcgacccggtatgcgtttctctgcccggcctgcggccctgcagcatccactcctcgcctctgctggcctctgccctcgctcgctgcgttcacccgagctcacccgagcccaccggagccgacagtggcgcgctaaggaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 1793 - DNA, 1629 bp, Homo sapiens
ccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttc

SEQ ID NO: 1794 - DNA, 1071 bp, Homo sapiens
atgccatctaccagatgttccacaccagcgtccccatgctcaaccttcccccagacctgttccgtctgttcaggaccaagacctaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 1795 - DNA, 870 bp, Homo sapiens
acagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaaccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagt

SEQ ID NO: 1796 - DNA, 2418 bp, Homo sapiens
ggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggaaaagcacaatcaacagtctgaatttactgttgaaagcttgatagccactgtaactgatatgtttggggctggaacagagacaacgagcaccactctgagatatggactcctgctcctgctgaagtacccagaggtcacagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaagggcacgaccataataacatccctgacttctgtgctgcacaatgacaaagaattccccaacccagagatgtttgaccctggccactttctggataagagtggcaactttaagaaaagtgactacttcatgcctttctcagcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattggcctctcccttctctctgtgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactagaaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacctgtagggaaatactggaacaatcatccataagagggatgaacattaagtgtttgaattcatgctctgcttttgtgttactgtaaacacaagatcaagatttggataatctttttcctttgtgtttccaacttagatcatgtctaaatatatgctttcatatggctaa

SEQ ID NO: 1797 - DNA, 2366 bp, Homo sapiens
gagatcttgccattgcactccagcctgggcaacaagagcgaaactccatctcaaggaaaaacaacaacaacaacaacaaaatcctgggctctgcttcagactagttaaaccagaatctccagggtggggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggaaaagcacaatcaacagtctgaatttactgttgaaagcttgatagccactgtaactgatatgtttggggctggaacagagacaacgagcaccactctgagatatggactcctgctcctgctgaagtacccagaggtcacagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaagggcacgaccataataacatccctgacttctgtgctgcacaatgacaaagaattccccaacccagagatgtttgaccctggccactttctggataagagtggcaactttaagaaaagtgactacttcatgcctttctcagcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattggcctctcccttctctctgtgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactagaaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacctgtagggaaatactggaacaatcatccataagagggatgaacattaagtgtttgaattcatgctctgcttttgtgttactgtaaacacaagatcaagatttggataatctttttcctttgtgtttccaacttagatcatgtctaaatatatgctttcatatggct

SEQ ID NO: 1798 - DNA, 2304 bp, Homo sapiens
cagccacgtcctcatggccctgctgctcttgctgttcctgggcctcctggggctctgggggctgctctgcgcctgcgcccaagacccctccccagctgcccggtggcccccggggcctcgcccgctgccgctcgtcgggaacctgcacttgctgcgtctgtcgcaacaggaccggtccctgatggagctctcagaacgctacgggccggtgttcaccgtgcacctggggcgccagaagacggtggtgctgacggggttcgaggcggtcaaagaggcgctggcgggccccgggcaggagctggccgaccggcctcccatcgccatcttccagctcatccagcgaggtggaggcatcttcttctcatctggggcgcgctggagggctgcccgccagttcacggtgcgtgccctgcacagcctgggcgtgggccgggagccggtggctgacaagattctgcaggagctgaaatgcctctctgggcagctggatggctacagaggccggcccttcccgctggccctactgggctgggctccctccaatatcaccttcgcgctcctcttcggccgccgatttgactaccgggaccccgtgtttgtgtccctgctgggtctcatcgatgaggtcatggtcctcttggggtcccctggcctgcagctgttcaacgtctacccatggctcggggccctgctccagctgcaccggcccgtcctgcgcaagatcgaggaggtccgtgccattctgaggaccctcctggaggcgcggaggccccacgtgtgcccgggggaccccgtgtgcagctatgtggacgccctgatccagcagggacagggggatgaccccgagggcctgtttgctgaggccaacgcggtggcctgcaccctggacatggtcatggccgggacggagacgacctcggccacgctgcagtgggccgcacttctgatgggccggcacccggacgtgcagggccgggtgcaggaggagctagaccgcgtgctgggccctgggcggactccccggctggaggaccagcaggctctgccctacacaagcgccgtgctccacgaggtgcagcggttcatcacgctcctgccgcacgtgccccgctgcaccgcggccgacacacagctgggcggcttcctgctccccaagggcacgcccgtgattcccctgctgacctcggtgctcctggatgagacacagtggcagaccccaggccagttcaaccccggccatttcctggacgcgaatgggcactttgtgaagcgggaggccttcctgcctttctctgcaggccgccgcgtctgtgttggggagcgcctggccaggaccgagctcttcctgctgtttgccggcctcctgcagaggtaccgcctgctgcccccgcctggcgtcagtccggcctccctggacaccacgcccgcccgggcttttaccatgaggccgagggcccaggccctgtgtgcggtgcccaggccctaggagctcccccagcccccaggtcctcctgaccactcccctcccagccctgggtcctcccaccctctctcctcccaccccacagctcggactgctctgggagggccctgaggactcccaccctcacccccacccccacagggtcagcaactgcttccggttacacccaggactacccctgcccgaccctgtgggacccccacccctctgatgctgtctgcagctcagtccctgccagcccccaggagcgcctccagggccccgcccactctcccacccctgaagctgcactcccacccacctagctccccccagggccccccagcacctacagctggggctgcagggagacaacgggtggctgcatccagccagagacaggcgcaggtgggtgtcctcagcgtgcgagccctgcaccccccaggtcctgggactcctgcagaccccactccattcccgctcctggaacacttcctgcagctgtgcctggaggcagtcggcctgcagtgccagactctgagccaagccactggggccatgcgtatgactggtgcagggaggcaaggcccacattctccttcagagacaggcactggcgccagaggcttccttggggcggggggagggcacctcagcccctgaagacaagcagcactgcagtggcaaaaatggaaacactgacccggtgcggtggctcatgcctgtaatcccagcactttgggaggccgaggcaggcgaatcacgaggtcaggagttcgagaccagcctgcccaacatggtgaaaccctgtctctactaaaaatacaaaaaaattaaccgag

SEQ ID NO: 1799 - DNA, 1949 bp, Homo sapiens
gcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagcttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattgtacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtgg

SEQ ID NO: 1800 - DNA, 1723 bp, Homo sapiens
cacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacaccctcatgcaactggagtctgtttaaggaacatcataaaagaacgaaaaggaaggaacttcagtcaacatatttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagcttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattgtacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttg

SEQ ID NO: 1801 - DNA, 4732 bp, Homo sapiens
aggcaatttttttcctccctctctccgctcccctcgcagcctccactccctttcccttggccccttcctccttctctgtttcggctggaggtgccaggacccccggccgcagcctcccctcccccgccgctccggtcccctcccgtcgggccctcccctcccccgccgcggccggcacagccaatcccccgagcggccgccaacatgctctttgagggcttggatctggtgtcggcgctggccaccctcgccgcgtgcctggtgtccgtgacgctgctgctggccgtgtcgcagcagctgtggcagctgcgctgggccgccactcgcgacaagagctgcaagctgcccatccccaagggatccatgggcttcccgctcatcggagagaccggccactggctgctgcagggttctggcttccagtcgtcgcggagggagaagtatggcaacgtgttcaagacgcatttgttggggcggccgctgatacgcgtgaccggcgcggagaacgtgcgcaagatcctcatgggcgagcaccacctcgtgagcaccgagtggcctcgcagcacccgcatgttgctgggccccaacacggtgtccaattccattggcgacatccaccgcaacaagcgcaaggtcttctccaagatcttcagccacgaggccctggagagttacctgcccaagatccagctggtgatccaggacacactgcgcgcctggagcagccaccccgaggccatcaacgtgtaccaggaggcgcagaagctgaccttccgcatggccatccgggtgctgctgggcttcagcatccctgaggaggaccttgggcacctctttgaggtctaccagcagtttgtggacaatgtcttctccctgcctgtcgacctgcccttcagtggctaccggcggggcattcaggctcggcagatcctgcagaaggggctggagaaggccatccgggagaagctgcagtgcacacagggcaaggactacttggacgccctggacctcctcattgagagcagcaaggagcacgggaaggagatgaccatgcaggagctgaaggacgggaccctggagctgatctttgcggcctatgccaccacggccagcgccagcacctcactcatcatgcagctgctgaagcaccccactgtgctggagaagctgcgggatgagctgcgggctcatggcatcctgcacagtggcggctgcccctgcgagggcacactgcgcctggacacgctcagtgggctgcgctacctggactgcgtcatcaaggaggtcatgcgcctgttcacgcccatttccggcggctaccgcactgtgctgcagaccttcgagcttgatggtttccagatccccaaaggctggagtgtcatgtatagcatccgggacacccatgacacagcgcccgtgttcaaagacgtgaacgtgttcgaccccgatcgcttcagccaggcgcggagcgaggacaaggatggccgcttccattacctcccgttcggtggcggtgtccggacctgcctgggcaagcacctggccaagctgttcctgaaggtgctggcggtggagctggctagcaccagccgctttgagctggccacacggaccttcccccgcatcaccttggtccccgtcctgcaccccgtggatggcctcagcgtcaagttctttggcctggactccaaccagaacgagatcctgccggagacggaggccatgctgagcgccacagtctaacccaagacccacccgcctcagcccagcccaggcagcggggtggtggttgtgggaggtagaaacctgtgtgtgggagggggccggaacggggagggcgagtggcccccatacttgccctcccttgctccccctccctggcaaaccctacccaaagccagtgggccccattcctagggctgggctccccttctggctccagcttccctccagccactccccatttaccatcagctcagcccctgggaagggcgtggcaggggctctgcatgcccgtgacagtgttaggtgtcagcgcgtgctacagtgtttttgtgatgttctgaactgctcccttccctccgttcctttcggacccttttagctggggttgggggacgggaagagccgtgcccccttgggcgcactcttcagcgtctcctcctcctgcgcccccactgcgtctgcccaggaacagcatcctgggtagcagaacaggagtcaaccttggcggggcgggggctgcgtccaacctggagattgcccttccctatgccacggttcccaccctccctcaccagtttggacaatttgaaattacctattgctgctacttgttctgtcctctgaccttggggcaaaggagccccaggccctgtctccccagcatcctccctggtggccctgggcaggtgcactgacacccccaccttcccatcccctgctgaaccaggccctgttacacacagccgcctaaggcccgcggctcatgtgctgcccgcccccatatttattcactgatagagaatcttggggatgctggggtctggagtgaacatctcctccccttcatgccctagcctgtgttctagctgtcctggcgagacttctgtgagtgaagaggaaggggtctctggtcaaacccagcccccagggcctagggttgaaagccttccccggctccgggcattatttgggtttaatctcggagcctcactcctggactgaagtccggtgcctctgccttatccctggtggagatggaatgtggcccattgcctcctccctctcctgtcaaaaaccctgatcaggtagatttggaggcggccacgatttcctgtttggcccctgttcaccccagtgcactggccctgactccaggcgtgagtatggggaaggatacgggttcttctgacggggagcaagggcctccgtcttcccttccttaactctccccctttgccctccgccctgaaaaaggtgtccttgaagtcccttccacctctatgccactgtctgcttagcccagctcaggggtggggaagaggcgaaagcgtgggggaggtgagcgcagcggcagttctgcctcggagctgattgcagggccctgtgtggtctccggacagctgcgggaaggctgccgcagctgaagctgaagaggcggctacgtgcggtttgtcagggggattgggttgaaaactggccagtcgggatgactgggtgaaagaggagtagctcctgccactggcgttttgagtgttggcaatttgggatgcctcctggggaaggtttccgggcgtttggtgagtctctagatttttccttgctttctgtgtttattggtttttgatgttgtaaaagcaatgaatcccctttacaagaaaatcgaaaacacagaagaatgaaggacatgccagtccccgatcgctgctgtgagcacctcagtggctccctcagaccagatcccgtaggcagccccacagaccgaccctgaccccactcacagccaccctgaagatagactataggaacgggcccataccacacagactgctctccaatccctgagtctcagatgtttcatttatttcctacttttccactactaaaaaacagtgtggaatagacattattggcaaaattgctcatccctaatcctgaaaaacaggccagaatgggtaaagacttgtcaaagcttgcaacatagctacatggtgcacccggacctgtaccccctccccccaacacaaaaccagtgtctgggaggttcattttcctttaaactgatccagctggccctgaaccaattgtttttgactgagtatctaggagagcagtaagtggaacttcagacaagcccactgggtctggtccaggtgaggggcagggggcatggggctgggaggtctcaggggccttccctgggggtggccagcctggtagggggcagagaaggaaaagctgaggggggtccctgtgagggaggaaagaaggatcatttgccccgctgggtctcaaaggcagtgagaagagagctgaagaaagctctggctggctgacaggatccctgtgttgtaattggtccctcctttcagctctctagtgagatgcccgtgtctgtgcgtgtgcgtgtgtgtttcatacagctagcattagatgggtgatgtttcttacttatcatccctaactattgcaacttgaccttaaaaagacaaaaccccacaaaactcttcctgccacgggcttgcagattgaagcactttcgatgttgggcgctggcgtttgtgttctgggcaccaccgtgaccctgcccagatggctataatattattttatacacaaaccttttttttcataaatgttataattttgtgtctgtctttataaactattataagtactatttttgttataattcaaaatagatatttagtataaagtttttgctgttaaatatttgttatttagtaaaatatgaattttgctctattgtaaacatggttcaaaatattaatatgtttttatcacagtcgttttaatattgaaaaagcacttgtgtgttttgttttgatatgaaactggtaccgtgtgagtgtttttgctgtcgtggttttaatctgtatataatattccatgttgcatattaaaaacatgaatgttgtgcattttgtgattttggaaatactcaatgtggctcttctataggcttctagaataaaccgtggggacccgc

SEQ ID NO: 1802 - DNA, 1346 bp, Homo sapiens
atgctctttgagggcttggatctggtgtcggcgctggccaccctcgccgcgtgcctggtgtccgtgacgctgctgctggccgtgtcgcagcagctgtggcagctgcgctgggccgccactcgcgacaagagctgcaagctgcccatccccaagggatccatgggcttcccgctcatcggagagaccggccactggctgctgcaggtcttctccaagatcttcagccacgaggccctggagagttacctgcccaagatccagctggtgatccaggacacactgcgcgcctggagcagccaccccgaggccatcaacgtgtaccaggaggcgcagaagctgaccttccgcatggccatccgggtgctgctgggcttcagcatccctgaggaggaccttgggcacctctttgaggtctaccagcagtttgtggacaatgtcttctccctgcctgtcgacctgcccttcagtggctaccggcggggcattcaggctcggcagatcctgcagaaggggctggagaaggccatccgggagaagctgcagtgcacacagggcaaggactacttggacgccctggacctcctcattgagagcagcaaggagcacgggaaggagatgaccatgcaggagctgaaggacgggaccctggagctgatctttgcggcctatgccaccacggccagcgccagcacctcactcatcatgcagctgctgaagcaccccactgtgctggagaagctgcgggatgagctgcgggctcatggcatcctgcacagtggcggctgcccctgcgagggcacactgcgcctggacacgctcagtgggctgcgctacctggactgcgtcatcaaggaggtcatgcgcctgttcacgcccatttccggcggctaccgcactgtgctgcagaccttcgagcttgatggtttccagatccccaaaggctggagtgtcatgtatagcatccgggacacccatgacacagcgcccgtgttcaaagacgtgaacgtgttcgaccccgatcgcttcagccaggcgcggagcgaggacaaggatggccgcttccattacctcccgttcggtggcggtgtccggacctgcctgggcaagcacctggccaagctgttcctgaaggtgctggcggtggagctggctagcaccagccgctttgagctggccacacggaccttcccccgcatcaccttggtccccgtcctgcaccccgtggatggcctcagcgtcaagttctttggcctggactccaaccagaacgagatcctgccggagacggaggccatgctgagcgccacagtctaacccaagacccacccgcctcagcccagcccagg

SEQ ID NO: 1803 - DNA, 1725 bp, Homo sapiens
gggcactcagagatccagcaggtgctgcaccatgagtgtctctgtcctgagccccagcagacgcctgggtggtgtctccgggatcctccaagtgacctccctgctcattctgcttctgctgctgatcaaggcagctcagctctacctgcataggcagtggctgctcaaagccctccagcagttcccgtgccctccctcccactggctcttcgggcacatccaggagttccaacacgaccaggagctacaacggattcaggaacgggtgaagacattcccaagtgcctgtccttattggatatggggaggcaaagttcgtgtccagctctatgaccctgactatatgaaggtgattctggggagatcagacccgaaatcccatggatcctacaaattcctggctccacggattgggtacggcttgctcctgttgaatgggcagacatggttccagcatcgacggatgctgaccccagccttccacaatgacatcctgaagccatacgtggggctcatggcagactctgtacgagtgatgctggacaaatgggaagagctccttggccaggattcccctctggaggtctttcagcacgtctccttgatgaccctggacaccatcatgaagagtgccttcagccatcagggcagcatccaggtggacaggaattctcagtcctacatccaggccattagtgacctgaacagcctggttttttgctgtatgaggaatgcctttcatgagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcacttggattttctggacatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccatggcctcctgggtgatggagcctccatcacctggaaccacctggaccagatgccctacaccaccatgtgcattaaggaggcactgaggctctacccaccggtgccaggcattggaagagagctcagcactcccgtcaccttccctgatgggcgctccttgcccaaaggtatcatggtcctcctctccatttatggccttcaccacaacccaaaagtgtggcccaacctagaggtgtttgacccttcccgttttgcaccgggttctgctcaacacagccacgctttcctgcccttctcaggaggatcaaggtgagacgtcctgtgtggtaattggaatagagaaatgagggaagtctctggtcaaccctctgatctttgtgagcccgatgttcatatgtggcatcttcaggtgtgctcttaaatattggtatttgtgggaaagtcaggcacctggtgtgggcgtctctgtgtacaaaaggaaggtggcattcagagcaccccatggagactttgctccctctgcttcttcaaatgggcagcctgaattcactgtcagtgcatgttccaaacttcagtatattcatgtattttcctcactttaaggatatgaattctcaaaattagatattctccagtaaa

SEQ ID NO: 1804 - DNA, 1780 bp, Homo sapiens
ggaaggggcactcagagatccagcaggtgctgcaccatgagtgtctctgtcctgagccccagcagacgcctgggtggtgtctccgggatcctccaagtgacctccctgctcattctgcttctgctgctgatcaaggcagctcagctctacctgcataggcagtggctgctcaaagccctccagcagttcccgtgccctccctcccactggctcttcgggcacatccaggagttccaacacgaccaggagctacaacggattcaggaacgggtgaagacattcccaagtgcctgtccttattggatatggggaggcaaagttcgtgtccagctctatgaccctgactatatgaaggtgattctggggagatcagacccgaaatcccatggatcctacaaattcctggctccacggattgggtacggcttgctcctgttgaatgggcagacatggttccagcatcgacggatgctgaccccagccttccacaatgacatcctgaagccatacgtggggctcatggcagactctgtacgagtgatgctggacaaatgggaagagctccttggccaggattcccctctggaggtctttcagcacgtctccttgatgaccctggacaccatcatgaagagtgccttcagccatcagggcagcatccaggtggacagaccaagtgatccaactgaggaaggctcaactacagaaggagggggagctggagaagatcaagaggaagaggcacttggattttctggacatcctcctcttggccaaagggcccctggtctgcccaggccttgctggtgttcaggatggaattgtttcaggaaccacctggaccagatgccctacaccaccatgtgcattaaggaggcactgaggctctacccaccggtgccaggcattggaagagagctcagcactcccgtcaccttccctgatgggcgctccttgcccaaaggtatcatggtcctcctctccatttatggccttcaccacaacccaaaagtgtggcccaacctagaggtgtttgacccttcccgttttgcaccgggttctgctcaacacagccacgctttcctgcccttctcaggaggatcaaggaactgcatcgggaaacaatttgccatgaaccagctgaaggtggccagggccctgaccctgctccgctttgagctgctgcctgatcccaccaggatccccatccccatggcacgacttgtgttgaaatccaaaaatggaatccacctgcgtctcaggaggctccctaacccttgtgaagacaaggaccagctttgagggcctccacctgccatcctgtcttcctgacccccactcctatctcctgcctgtctgcctctgtcctgctttctgtctgcccaccttcccttcttcccacctgcctgctgtcccccagtctgcctgcccttctctctctcacctttctccaagctccctacctgcttgtctacctgtctcctacccacctgtatatcttgttgggagaaaagctgagtgttgggagaagctgaggccgagcttgcatgtctgacataatgtaaaagagtcttgaatcatgtccaggatccagggtctaaaaccccttgtggcctttggaacaccaagctctgtgctgaagggtggaaggctaccctgacgcaccataatctaagcccggggcataaaacccctcgtggcttggatagaatccagggctcgtggctctggaatgtgtctggacttgctggctcctcgctccttgctctcccaggatcaa

SEQ ID NO: 1805 - DNA, 2535 bp, Homo sapiens
gggcactcagagatccagcaggtgctgcaccatgagtgtctctgtcctgagccccagcagacgcctgggtggtgtctccgggatcctccaagtgacctccctgctcattctgcttctgctgctgatcaaggcagctcagctctacctgcataggcagtggctgctcaaagccctccagcagttcccgtgccctccctcccactggctcttcgggcacatccaggagttccaacacgaccaggagctacaacggattcaggaacgggtgaagacattcccaagtgcctgtccttattggatatggggaggcaaagttcgtgtccagctctatgaccctgactatatgaaggtgattctggggagatcagacccgaaatcccatggatcctacaaattcctggctccacggattgggtacggcttgctcctgttgaatgggcagacatggttccagcatcgacggatgctgaccccagccttccacaatgacatcctgaagccatacgtggggctcatggcagactctgtacgagtgatgctggacaaatgggaagagctccttggccaggattcccctctggaggtctttcagcacgtctccttgatgaccctggacaccatcatgaagagtgccttcagccatcagggcagcatccaggtggacaggaattctcagtcctacatccaggccattagtgacctgaacagcctggttttttgctgtatgaggaatgcctttcatgagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcacttggattttctggacatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccatggcctcctgggtgatggagcctccatcacctggaaccacctggaccagatgccctacaccaccatgtgcattaaggaggcactgaggctctacccaccggtgccaggcattggaagagagctcagcactcccgtcaccttccctgatgggcgctccttgcccaaaggtatcatggtcctcctctccatttatggccttcaccacaacccaaaagtgtggcccaacctagaggtgtttgacccttcccgttttgcaccgggttctgctcaacacagccacgctttcctgcccttctcaggaggatcaaggaactgcatcgggaaacaatttgccatgaaccagctgaaggtggccagggccctgaccctgctccgctttgagctgctgcctgatcccaccaggatccccatccccatggcacgacttgtgttgaaatccaaaaatggaatccacctgcgtctcaggaggctccctaacccttgtgaagacaaggaccagctttgagggcctccacctgccatcctgtcttcctgacccccactcctatctcctgcctgtctgcctctgtcctgctttctgtctgcccaccttcccttcttcccacctgcctgctgtcccccagtctgcctgcccttctctctctcacctttctccaagctccctacctgcttgtctacctgtctcctacccacctgtatatcttgttgggagaaaagctgagtgttgggagaagctgaggccgagcttgcatgtctgacataatgtaaaagagtcttgaatcatgtccaggatccagggtctaaaaccccttgtggcctttggaacaccaagctctgtgctgaagggtggaaggctaccctgacgcaccataatctaagcccggggcataaaacccctcgtggcttggatagaatccagggctcgtggctctggaatgtgtctggacttgctggctcctcgctccttgctctcccaggatcaattgtatcttgagttaaaagaacctgctctccattatctcaagtaacagagcagatgctaaaccgtcacagctgtaaatcatgtgcttaatgcaacatgccctttcgacccaccccccattctcaccacctgtttctttgtttgatcaccaataaataatctgcacttccagagctcggggccttcacagcctccatacttagctttggcgccctggacccactttctctctcaaactgtcttttctcattcctttgactctgccggactttgtcacccccacaacctggtgttgggtccgataaccccaacatccctgaatctccacccacctcccaaactcctgcctgccctccagactgtctgcccatacacctgtctccttcttcctgcctgcttgtctgttcctatattagtttcctattgctgctgtaataaactatcacaatctcagtgattttaaataa

SEQ ID NO: 1806 - DNA, 2171 bp, Homo sapiens
aggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtagctctgatgagaatggggtcccagatggctcaggctgtgacctccctgggcaccaccctccccaggctgggtgtggaggagttggggccccctgccttcaggaggcttgtagtttagaagggaagtaggcattaccatagacgactcctagaggacagtgctatgtaaaaatgtgtgtctataaatgtttatcatgcatgtattctagagctcattcatttattcaacaaacatttggtgagcacctatttcgttcgagaaacttcatttatctcctataattggcaaacttaaaaatgcagcagaaacttacattccaaccttagagactcatagtgagcacaaggaaagttttgccctgagattcatggttatggctgggtaccaccaaatagaagaatggcttaggggagtgccccttcactgagatgtgtttctttgttgaactttgtgtgtgtgtgtttagaatataacagacataagaaaaaattacctaaatgaagactgtacaaaataataaataattctgaagcagactctcttgtaaccatcactgaagtcaagaaatatggaatatggtatcactgatgtgtcttctgc

SEQ ID NO: 1807 - DNA, 1494 bp, Homo sapiens
atggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagcagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtag

SEQ ID NO: 1808 - DNA, 2110 bp, Homo sapiens
aggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagcagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtagctctgatgagaatggggtcccagatggctcaggctgtgacctccctgggcaccaccctccccaggctgggtgtggaggagttggggccccctgccttcaggaggcttgtagtttagaagggaagtaggcattaccatagacgactcctagaggacagtgctatgtaaaaatgtgtgtctataaatgtttatcatgcatgtattctagagctcattcatttattcaacaaacatttggtgagcacctatttcgttcgagaaacttcatttatctcctataattggcaaacttaaaaatgcagcagaaacttacattccaaccttagagactcatagtgagcacaaggaaagttttgccctgagattcatggttatggctgggtaccaccaaatagaagaatggcttaggggagtgccccttcactgagatgtgtttctttgttgaactttgtgtgtgtgtgtttagaatataacagacataagaaaaaattacctaaatgaagactgtacaaaataataaataattctgaagcaga

SEQ ID NO: 1809 - DNA, 951 bp, Homo sapiens
agacagagagaggaggttgtctgggacagactgctcctgacagaaggatgtcccagctgagcctgtcctggctgggcctctggccagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatgctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggccatgacaccacggccagtggtctctcctgggtcctgtaccaccttgcaaagcacccagaataccaggagcgctgccggcaggaggtgcaagaacttctgaaggaccgtgagcctaaagagattgaatgg

SEQ ID NO: 1810 - DNA, 2360 bp, Homo sapiens
agcagacagagagaggaggttgtctgggacagactgctcctgacagaaggatgtcccagctgagcctgtcctggctgggcctctggccagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatactgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacatt

SEQ ID NO: 1811 - DNA, 1713 bp, Homo sapiens
agcagacagagagaggaggttgtctgggacagactgctcctgacagaaggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggtgagtatctgcaggtgaacagggttgggaaaaacgttggggggccaggggagggagaggtccttgcccatggcccttggctgccctgctaggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaac

SEQ ID NO: 1812 - DNA, 2357 bp, Homo sapiens
caaaagcagttgggccgaacgaagcgtgcgcgctttggtaaccggctagaaatcccgcacgcgcgcctgcctcctctccccaggcctgagctgcccctcccactgcctttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatggaattctcctggctggagacgcgctgggcgcggcccttttacctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattcctta

SEQ ID NO: 1813 - DNA, 2322 bp, Homo sapiens
aagtggccttggccttctgttatttcagatccagcagatggggagactgaacaaagtggtatcctgggcccaccagtttttctacactcacccactctggtttgaaccgttcactggcttccagaacatttgagcccaactatgtcaaagctgtgtgtagccacaggggtgaggtgttcttgggagagctgctcttcctgagaacaaagggctcaggctatgatgtggggaggaggcctggacctgtgtcctatgcctgggcagctgaagttcccaccctgcttatcaaggtgcctcctctgggaaccccctagtctctatttgacccaaccaacttcttcacttgcagaacctcaagccctaatatgtatgacttcttcctccagtggattgtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattcctt

SEQ ID NO: 1814 - DNA, 1906 bp, Homo sapiens
agaatggagccctcctggcttcaggaactcatggctcaccccttcttgctgctgatcctcctctgcatgtctctgctgctgtttcaggtaatcaggttgtaccagaggaggagatggatgatcagagccctgcacctgtttcctgcaccccctgcccactggttctatggccacaaggagttttacccagtaaaggagtttgaggtgtatcataagctgatggaaaaatacccatgtgctgttcccttgtgggttggaccctttacgatgttcttcagtgtccatgacccagactatgccaagattctcctgaaaagacaagatcccaaaagtgctgttagccacaaaatccttgaatcctgggttggtcgaggacttgtgaccctggatggttctaaatggaaaaagcaccgccagattgtgaaacctggcttcaacatcagcattctgaaaatattcatcaccatgatgtctgagagtgttcggatgatgctgaacaaatgggaggaacacattgcccaaaactcacgtctggagctctttcaacatgtctccctgatgaccctggacagcatcatgaagtgtgccttcagccaccagggcagcatccagttggacagtaccctggactcatacctgaaagcagtgttcaaccttagcaaaatctccaaccagcgcatgaacaattttctacatcacaacgacctggttttcaaattcagctctcaaggccaaatcttttctaaatttaaccaagaacttcatcagttcacagagaaagtaatccaggaccggaaggagtctcttaaggataagctaaaacaagatactactcagaaaaggcgctgggattttctggacatacttttgagtgccaaaagcgaaaacaccaaagatttctctgaagcagatctccaggctgaagtgaaaacgttcatgtttgcaggacatgacaccacatccagtgctatctcctggatcctttactgcttggcaaagtaccctgagcatcagcagagatgccgagatgaaatcagggaactcctaggggatgggtcttctattacctgggaacacctgagccagatgccttacaccacgatgtgcatcaaggaatgcctccgcctctacgcaccggtagtaaacatatcccggttactcgacaaacccatcacctttccagatggacgctccttacctgcaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaattttaagtcctttcgtataagaattaatgagacaattttcctaccaaaggaagaacaaaaggataaatataatacaaaatatatgtatatggttgtttgacaaattatataacttaggatacttctgactggttttgacatccattaacagtaattttaatttctttgctgtatctggtgaaacccacaaaaacacctgaaaaaactcaagctgacttccactgcgaagggaaattattggtttgtgtaactagtggtagagtggctttcaagcatagtttgatcaaaactccactcagtatctgcattacttttatctctgcaaatatctgcatgatagctttattctcagttatctttccccataataaaaaatatctgccac

SEQ ID NO: 1815 - DNA, 3093 bp, Homo sapiens
gtcctctcgccgctccgacgccagcagcgcccgcgtgccgctcgcccagtcccgggggagcccctgcaagtttcccgggccgcgcgccgcgctcgctcgcctcccagcccgcggcccgagccgccgccgcgcccgccatgccctcggccaaacaaaggggctccaagggcggccacggcgccgcgagcccctcggagaagggtgcccacccgtcgggcggcgcggatgacgtggcgaagaagccgccgccggcgccgcagcagccgccgccgccgcccgcgccgcacccgcagcagcacccgcagcagcacccgcagaaccaggcgcacggcaagggcggccaccgcggcggcggcggcggcggcggcaagtcctcctcctcctcctccgcctccgccgccgctgccgccgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcagccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 1816 - DNA, 10763 bp, Homo sapiens
gcggagggcggggggaggggaggggagggggcgcggggccgcggcagcggagctcgcatcctcggcggggcggctgtgcaggaggcggcgcccgggcgtcagcggacggaccgatcgacggccaagggcgcgcggaccgacggcggctgcccggaggggatcgcgggcctcggagacagcgactgcggacgatgcgcggcctcaggccccgcgcgagcgggcgctgcccggggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccacagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggcctctggggccctcaggagggccagcccatgagctggagctggaggcccgggatgggggctccccaccacgcaccagccactttcgactacgggtggtggtacaggatgtgggaacccgtgggctggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccgggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgcttacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacagagggagcccagccctggtgggctcagctaccttgacggtgatggtcatcgacaccaatgacaatcgccccaccatcccccaaccctgggagctccgagtgtcagaagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggccgtgccaacctcacagtgcttgtggaggatgtcaatgacaatgcacctgccttctcacagagcctctaccaggtaatgctgcttgagcacacacccccaggcagtgccattctctccgtctctgccactgatcgggactcaggtgccaacggtcacatttcctaccacctggcttcccctgccgatggcttcagtgttgaccccaacaatgggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgaggacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccag

SEQ ID NO: 1817 - DNA, 948 bp, Homo sapiens
cttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagcgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtc

SEQ ID NO: 1818 - DNA, 2279 bp, Homo sapiens
gacccagttccgaggactggagaggggatagaaccttgtgtccaaggaggtccttcaggagacctgggatgagtggtgcttccccaaaacagactcatggacattaaacatcatcagaatggcacaagagggcaaagaagaaaacagcctcataccacggtgcagaggctcctgacctgggggctgccagtctcctgtagctggttcctgtggcgccagccgggcgagtttcctgtcactgctctcctgctgggggcaggcgctggggggctcctggccataggtctctttcagctcctggtgaaccccatgaacatctacgaagaacagaagattatgttcttgtacagcttggtgggcttgggggccatgggctgggggacctcccctcacatccgctgtgccagcctcctactagtacccaagatgctgggcaaggaaggcaggctctttgtcctgggatacgccttggctgccatctatgtggggccagtagccaatctgcgacacaatctcaacaacgtgatcgcatcgctgggctgcaccgtggagctgcagatcaacaacacccgcgcagcttggcgcatctccacagcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattctgctgctgctggtggtgctgtgtggcttggactgggctctctactccatcttcgacaccatccgccaccactccttcctgcagtactccttccgcagcagtcataaactggaggtgaaggtcgggggagactccatgctagcccggcttcttcgaaaaaccattggggccctgaacacctcctcagagacagtgatggaatcaaacaacatgccctgcctgccccagcctgtgggcctggatgccagggcctactggagagctgcagtaccgattggcctgttagtgtgtctctgcctgttacaggcttttggctaccgactccggagggtcatcgcagccttctacttccccaagcgagagaagaagcggatcctgttcctctacaatgacctattgaagaaaagagcagccttcaccaaactcaggagggccgctatcctgaggcgggagcgacagcagaaggctccgcgccacccgctggcggatatcctgcaccgcggctgcccgctcctgcgccgctggctgtgccggcgctgcgtggtgtgccaggcacccgagacgcccgagtcctacgtgtgccggacgctggactgcgaggccgtgtactgctggtcgtgctgggacgacatgcggcagcggtgcccggtctgcacgccccgcgaagagctctcttcctccgcctttagtgacagcaacgacgacactgcctacgcggggtgaagaggcgtcctgctcgctcttccgcaccgtccttcccggttaataaaatgccctgtacgctt

SEQ ID NO: 1819 - DNA, 2207 bp, Homo sapiens
agaaccttgtgtccaaggaggtccttcaggagacctgggatgagtggtgcttccccaaaacagactcatggacattaaacatcatcagaatggcacaagagggcaaagaagaaaacagcctcataccacggtgcagaggctcctgacctgggggctgccagtctcctgtagctggttcctgtggcgccagccgggcgagtttcctgtcactgctctcctgctgggggcaggcgctggggggctcctggccataggtctctttcagctcctggtgaaccccatgaacatctacgaagaacagaagattatgttcttgtacagcttggtgggcttgggggccatgggctgggggacctcccctcacatccgctgtgccagcctcctactagtacccaagatgctgggcaaggaaggcaggctctttgtcctgggatacgccttggctgccatctatgtggggccagtagccaatctgcgacacaatctcaacaacgtgatcgcatcgctgggctgcaccgtggagctgcagatcaacaacacccgcgcagcttggcgcatctccacagcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattctgctgctgctggtggtgctgtgtggcttggactgggctctctactccatcttcgacaccatccgccaccactccttcctgcagtactccttccgcagcagtcataaactggaggtgaaggtcgggggagactccatgctagcccggcttcttcgaaaaaccattggggccctgaacacctcctcagagacagtgatggaatcaaacaacatgccctgcctgccccagcctgtgggcctggatgccagggcctactggagagctgcagtaccgattggcctgttagtgtgtctctgcctgttacaggcttttggctaccgactccggagggtcatcgcagccttctacttccccaagcgagagaagaagcggatcctgttcctctacaatgacctattgaagaaaagagcagccttcaccaaactcaggagggccgctatcctgaggcgggagcgacagcagaaggctccggtcttcactgagcctcagtttctccctctgaagaatggcaagactggagagatctgtaaggcctgctcactggagatcagcctagagtggtggtcaggtgtgggactccggtgccagagggcctaagtgtgtatcccggctccttccctcattactatgacaacggtgtgaccttgagcacatgacttaactgctgtgcctgggcttttgccttccataaaatggggttaactactccatctggttgttttaaggattaaatgagttgtac

SEQ ID NO: 1820 - DNA, 2091 bp, Homo sapiens
gacccagttccgaggactggagaggggatagaaccttgtgtccaaggaggtccttcaggagacctgggatgagtggtgcttccccaaaacagactcatggacattaaacatcatcagaatggcacaagagggcaaagaagaaaacagcctcataccacggtgcagaggctcctgacctgggggctgccagtctcctgtagctggttcctgtggcgccagccgggcgagtttcctgtcactgctctcctgctgggggcaggcgctggggggctcctggccataggtctctttcagctcctggtgaaccccatgaacatctacgaagaacagaagattatgttcttgtacagcttggtgggcttgggggccatgggctgggggacctcccctcacatccgctgtgccagcctcctactagtacccaagatgctgggcaaggaaggcaggctctttgtcctgggatacgccttggctgccatctatgtggggccagtagccaatctgcgacacaatctcaacaacgtgatcgcatcgctgggctgcaccgtggagctgcagatcaacaacacccgcgcagcttggcgcatctccacagcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattctgctgctgctggtggtgctgtgtggcttggactgggctctctactccatcttcgacaccatccgccaccactccttcctgcagtactccttccgcagcagtcataaactggaggtgaaggtcgggggagactccatgctagcccggcttcttcgaaaaaccattggggccctgaacacctcctcagagacagtgatggaatcaaacaacatgccctgcctgccccagcctgtgggcctggatgccagggcctactggagagctgcagtaccgattggcctgttagtgtgtctctgcctgttacaggcttttggctaccgactccggagggtcatcgcagccttctacttccccaagcgagagaagaagcggatcctgttcctctacaatgacctattgaagaaaagagcagccttcaccaaactcaggagggccgctatcctgaggcgggagcgacagcagaaggctccggtcttcactgagcctcagtttctccctctgaagaatggcaagactggagagatctgtaaggcctgctcactggagatcagcctagagtggtggtcaggtgtgggactccggtgccagagggcctaa

SEQ ID NO: 1821 - DNA, 2199 bp, Homo sapiens
agttccgaggactggagaggggatagaaccttgtgtccaaggaggtccttcaggagacctgggatgagtggtgcttccccaaaacagactcatggacattaaacatcatcagaatggcacaagagggcaaagaagaaaacagcctcataccacggtgcagaggctcctgacctgggggctgccagtctcctgtagctggttcctgtggcgccagccgggcgagtttcctgtcactgctctcctgctgggggcaggcgctggggggctcctggccataggcttgggggccatgggctgggggacctcccctcacatccgctgtgccagcctcctactagtacccaagatgctgggcaaggaaggcaggctctttgtcctgggatacgccttggctgccatctatgtggggccagtagccaatctgcgacacaatctcaacaacgtgatcgcatcgctgggctgcaccgtggagctgcagatcaacaacacccgcgcagcttggcgcatctccacagcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattctgctgctgctggtggtgctgtgtggcttggactgggctctctactccatcttcgacaccatccgccaccactccttcctgcagtactccttccgcagcagtcataaactggaggtgaaggtcgggggagactccatgctagcccggcttcttcgaaaaaccattggggccctgaacacctcctcagagacagtgatggaatcaaacaacatgccctgcctgccccagcctgtgggcctggatgccagggcctactggagagctgcagtaccgattggcctgttagtgtgtctctgcctgttacaggcttttggctaccgactccggagggtcatcgcagccttctacttccccaagcgagagaagaagcggatcctgttcctctacaatgacctattgaagaaaagagcagccttcaccaaactcaggagggccgctatcctgaggcgggagcgacagcagaaggctccgcgccacccgctggcggatatcctgcaccgcggctgcccgctcctgcgccgctggctgtgccggcgctgcgtggtgtgccaggcacccgagacgcccgagtcctacgtgtgccggacgctggactgcgaggccgtgtactgctggtcgtgctgggacgacatgcggcagcggtgcccggtctgcacgccccgcgaagagctctcttcctccgcctttagtgacagcaacgacgacactgcctacgcggggtgaagaggcgtcctgctcgctcttccgcaccgtccttcccggttaataaaatgccctgtacgctt

SEQ ID NO: 1822 - DNA, 2000 bp, Homo sapiens
agaatacggtgagaaattccaggagcacagaagtcagcgggcatctcctggagacaggcagacatttggtctcagcagccatgcccaaagtcatgaaggatgttgtgcaccccttggggggagaggagcctagcatggcgagagctgtggttcgcagcgtgggaggttttaccctgggcttgtctttagccacggcctacgggcttctggagctactggtggaaggccacagcccctggggttgcctggtgggcaccctcactttggctgccttccttagcctgggcatgggattctctcgccaggtccgagccactgtcctcctgctgctgcctcaggccttctccaggcagggccggacactactgttggtggctgcttttgggttggtgcttcaagggccttgtgccaacactctacgcaacttcacccgggccagcgaggctgtagcctgtggggcagagctggccctgaaccagaccgccgaagtgctacagagggccaagcaacctcttgtcagtgccctgaacaagattaaagctattgcccggaagaccaaagaggtggctgaccgggtccgcaagttctttcggtcaatcatggatggtgtgaaacacatagccagggctctccggaatgtgtggcagtggctcctgcacatcggcgatgtgtgcaactcggaactgggcaacccttacctgaagtgtgcacgggttttcgatgatgccaaggacagctgcatgatggtcataccacaagcctaccacctgtgttacgtgctcatgcccttcaaactggcgctctgtggacttgccagcctggtccaggtgttctgcgtcatccctaagtacattcaacccttcttgcgccagaccatcggcacccccgtgattcagttgctcaaccgggtgcgtcaggagtttgagttcaacatgacagccacccaccacttctctgtggatctcaatgcctctcggagcctgtcccaggtagccatggacctccacgaggctgtcagcatgaagctgcaccgtgtccgagaggccctggctctgatgggcttcaccacgcctctgctgcttgtgcttctctacctccaagccctattttaccggtattgttacctgaactgggaccattatgacaatatctacatcactagccgattcctgcgcatggaggctgtgcgctccacggcagggctgcccacagtgctaccgctcagtgctcacgaggccaggcgctacatcccaccgggctccatcttcttgtcccaatgggagaagtttttttacattctggagaccttcaaccttatccgacacctcctcctcgtgctgttcctagtcttcctagactatgctgtcttctgggtgcttgacctggcccggcaccagctgcagggggagattgtggcccgcagtcctgtgttggtgtctctaaccgtggaaggtactggctacgctgggaatatttatcgtgacctggtgtcagcatttgatgtcctgcagcaaggcaacatcagtattttgtcccggcgttgtctccttcgtccctcggagcctgacagcactggctacatagtcattggcgtcatgtatggcctatgcttcttcatcaccctgtttggcagctatgtcagccggctgcggcgagtcatctgtgcctcctactacccatcccgggagcaggagaggatctcctacctgtacaatgtacttctgagccgccgaaccaatctgttggctgccctgcaccgatcagtgaggcggcgggcggctgaccagggccacagaagtgccttcctagtgctggccagtcggtgcccctgcctaggtccatttgtcagccacttttggctgcatcaggcctactgcctgggctgtgggcagccccaggatgagggagacatggagaacactgtgtcctgcagtacccccggctgccaaggatttatatgcaagtggcattgcagcagctccctagtgtgcaccccttga

SEQ ID NO: 1823 - DNA, 2392 bp, Homo sapiens
ggagcacagaagtcagcgggcatctcctggagacaggcagacatttggtctcagcagccatgcccaaagtcatgaaggatgttgtgcaccccttggggggagaggagcctagcatggcgagagctgtggttcgcagcgtgggaggttttaccctgggcttgtctttagccacggcctacgggcttctggagctactggtggaaggccacagcccctggggttgcctggtgggcaccctcactttggctgccttccttagcctgggcatgggattctctcgccaggtccgagccactgtcctcctgctgctgcctcaggccttctccaggcagggccggacactactgttggtggctgcttttgggttggtgcttcaagggccttgtgccaacactctacgcaacttcacccgggccagcgaggctgtagcctgtggggcagagctggccctgaaccagaccgccgaagtgctacagagggccaagcaacctcttgtcagtgccctgaacaagattaaagctattgcccggaagaccaaagaggtggctgaccgggtccgcaagttctttcggtcaatcatggatggtgtgaaacacatagccagggctctccggaatgtgtggcagtggctcctgcacatcggcgatgtgtgcaactcggaactgggcaacccttacctgaagtgtgcacgggttttcgatgatgccaaggacagctgcatgatggtcataccacaagcctaccacctgtgttacgtgctcatgcccttcaaactggcgctctgtggacttgccagcctggtccaggtgttctgcgtcatccctaagtacattcaacccttcttgcgccagaccatcggcacccccgtgattcagttgctcaaccgggtgcgtcaggagtttgagttcaacatgacagccacccaccacttctctgtggatctcaatgcctctcggagcctgtcccaggtagccatggacctccacgaggctgtcagcatgaagctgcaccgtgtccgagaggccctggctctgatgggcttcaccacgcctctgctgcttgtgcttctctacctccaagccctattttaccggtattgttacctgaactgggaccattatgacaatatctacatcactagccgattcctgcgcatggaggctgtgcgctccacggcagggctgcccacagtgctaccgctcagtgctcacgaggccaggcgctacatcccaccgggctccatcttcttgtcccaatgggagaagtttttttacattctggagaccttcaaccttatccgacacctcctcctcgtgctgttcctagtcttcctagactatgctgtcttctgggtgcttgacctggcccggcaccagctgcagggggagattgtggcccgcagtcctgtgttggtgtctctaaccgtggaaggtactggctacgctgggaatatttatcgtgacctggtgtcagcatttgatgtcctgcagcaaggcaacatcagtattttgtcccggcgttgtctccttcgtccctcggagcctgacagcactggctacatagtcattggcgtcatgtatggcctatgcttcttcatcaccctgtttggcagctatgtcagccggctgcggcgagtcatctgtgcctcctactacccatcccgggagcaggagaggatctcctacctgtacaatgtacttctgagccgccgaaccaatctgttggctgccctgcaccgatcagtgaggcggcgggcggctgaccagggccacagaagtgccttcctagtgctggccagtcggtgcccctgcctaggtccatttgtcagccacttttggctgcatcaggcctactgcctgggctgtgggcagccccaggatgagggagacatggagaacactgtgtcctgcagtacccccggctgccaaggtctctactgcctcacttgcttccgcctcctggacaatacctgctccgtgtgtgcatctcccctctcctaccagggggacctggacctggagctggactccagcgatgaggagggccctcagctatggctggctgcagctcaaaggaaggaccctgagcaggcatggttattgcagcaacagctccaagaagtgctcggcaggagcctctcaatggagtccacttccgagtccagtgacctggatgaggagaaggggcctcagcagaggaagcacgggcagcagcccttacctgaagcccatcagcctgtcagcattctcaccagccctgagccccacagaccacctgagacatcctccgccactaaaggagcccccactccagcttcagaaccctcagtccctctctcacctccctctcttcctgatccttcccacccaccccccaaataaaccaaaagtgg

SEQ ID NO: 1824 - DNA, 5828 bp, Homo sapiens
actaggaactacatttcccggtgagagagcggctccggccggccgcgcggtaccggagcgtcgcactgtcagcggccagagagcctggggcagatcgaaaagggagtgcttcttcccttctctccgcgctctggcggtgcaagcggctctgctttccctcgccccgccgtcgggtgctccctgcccgcctccccgtgtcagctttccctgggccccgccgggaaagtctgggcctcgaaattcgaaggcagcggcggctgcccagcacgggagtgtggggcgcgccactcggcggcccagcctacccagggcccggcccgcgcctccatgggcccgacccggaagcccaacgtgtgcagccggctgagtcgccgggcgctgggctgcttctcgcgcgacgcaggcgtggtgcagaggaccaacctgggcatcctgcgggcgctggtgtgccaggaaagtactaaatttaagaatgtctggacaactcattccaggtcacctatagcctatgagagaggaagaatatattttgacaattatcggcgctgtgtcagcagtgttgcatctgagccaagaaaactttatgaaatgccaaaatgttccaaatcagaaaaaatagaggatgctttattatgggaatgcccagtgggagatatacttcccaattcatcagattataagtcctcactcatagcactgactgctcataattggctacttcgtatatcagcaactacgggaaaaatccttgagaaaatatatcttgcaccttattgcaaattcagatacttgagctgggacactcctcaagaagtcattgcagttaagtcagctcagaacagaggctcagcagtggcccggcaggcaggcattcaacaacatgttttgctgtaccttgcagtgttccgagttctacctttttcacttgtagggattctagagatcaacaaaaagatttttgggaacgttacagatgctaccttgtctcatggaatactgattgtgatgtacagctcaggactggtcagactctatagcttccaaaccatcgctgaacagttcatgcaacagaaacttgacttagggtgtgcatgcagatggggtgggactactggaactgtaggagaggctccttttggcattccttgtaatattaaaatcacagacatgccaccactgctctttgaggtgtcatccctggagaatgcttttcagattggaggccatccttggcactacatcgtcacacctaataagaagaaacagaaaggagttttccatatttgtgccctaaaagacaattccctggcaaaaaatgggatccaagaaatggattgttgttctctagaatctgactggatctatttccatcctgatgcttctggtagaataatacatgttggtccaaatcaagtcaaagttttgaagctaactgaaatagaaaataatagttctcagcatcagatctctgaagattttgtcattttggccaacagggagaaccataaaaatgaaaatgtactcactgttacagcttctggacgggtggtaaaaaaaagttttaaccttctggatgatgacccagaacaagagactttcaaaattgtggactatgaagatgagttagatttgctttctgtggtagctgttactcaaatagatgctgaaggaaaagctcacctggatttccactgtaatgaatatggaactttacttaaaagcattccactagtggagtcatgggatgtgacatatagccatgaagtctactttgacagagacttggtgctacacatagagcagaaacccaacagagtcttcagctgctatgtttaccagatgatatgtgacactggggaagaagaagaaaccataaacagaagctgttaaaaagagtgagataattgtaacctaagagacttttagccaaacaccccagcagctgcgtccaatccattttattatctgcatggcacattctccagtattttccaaaaaagtcttgtgttgacttcagatgactatgacttcttttttaaactcttgctgtaaaagatggtgaggacttcattttttttaaaggttttttagaatactgttccaagaagtttagtgttttgcagctttgagctaggtggtaatgcaaatataaaatgctgggaacagaaaaggacaggttaattccaattgttgaggagttaagtcattgatggggtgggtcattgatgagttcttaaaggatggtatggaattttgtttgttaaggctaggaaagacagggagagacaaaagtaaacatgcagaaagaaatcttatatcctctataccaaactttgcttaaggatgagaaatgagatgtgttatgtgagaacattattttgagcccaaaatgtgtcatcacagtttttaaaaatcttatatatgtatttatatgtgtttcgtatttgtatatagtatcaggaattggttctagttcccaaattatcttttcttccttggttttgttctcttggcttgatgttcacattgaatatttgtgtttctatataggctaatgtaaaagattccaagcaaaccttaagtgaaattgttttctgatttgcatcctgtttagctcttaatgtatctaaggatgttctcatctcaccattctactcatttagtgagttttctgatcttgtttaggcaatatttgcatacttatgcaataagataaaggtacccttgcctgcagtagttctgtttcctgtagaaaagtggataaagagtcccagaagaagttcttactagcttgggagttacctgattaaccagagaaaatttttggcttacttatggaacaagcattatttcttctttgttaggaaagatctaaatatggtccttgacttttaataatcattctttagaatgttaaataaaggcaacccaagtaaagggagaaaatgtttctttgtgcttcctgtttgagaaattcagttgcttccatttcgcatgttctgcacatttatccgatgtaacctcaaaagaataactggtaataagggaaggaaacagcagcaacaatcattgctgattcaagtttaaggttaaaatatggaatttttagcttggatgatttatattaaaatctttccattttttttttcagttttggcttgatgccatgttaagaatgatgtgaattcttcccagttctgccctggtgctagacattgccccatactttcaattagacactagctgtatctaaatagtcccactcagtaaacttacatcttgaaaaacaagaccagtaagaggccagtgaaagtactaaagaaagaaaccaatgttgtgtgagtttcaaagcagctgcaatgctgtgtaaaagtagagtgttcattctccatttccaagagtgtttcagaataggatgtcttaagacttcagtcatgtcagagatttttttttttaggtgattattgagtttctccttctcctttaagtcatcaccttccttttatgaaatgatagtaaggaactcgtctattctgaaaggcatttgagaaatagctgaattcctggctgcttttttgctgggggtagatggtggaatacttctggtctagatataacttaccactaagaaacccccagtatgtcaccactgcctaaatctaactagaccagggtccaaatgccatccaggccaggcaggaaatatacctcatgtgaaagacagtaaggagttgtgggcagtgtaacaaacaggagagctatgccccaactaaaaggagcagctgctactgcttagtttcagccagttgcaacagtatgtgggaatgtaggctgcatggttgttaacaagatagatggtaaaaagatgccagaagatacagaagatagcaaagaatgtggggaatttggataccacacatagcgagagacaatgaagcatgcttcccagctcgccagagtgtcacacagctgctcattctgccacctgccagacattaatgtcttcctgccctacctaaaccccctctttacctgatattttaattcgagactctagctacatgcccacctacttaacaggtactagtgacaggtacaaaacattatgggtaacaattctgagtgtttaatgcaagcccaggtgaagcagggtagcttccatcagcaggtacagacgttacgctgaaaagaggtgcattctgcattgcactcctggatctaagtttctgcattctcagagcatcaatgcagcaagcttattgttcctcaattttttacaatatttatcacaactctgggagaaaacaaaacaaatcctatcctatttactatttgtgctacctagtgaggagataccgctctgtttagacaaattaaggcacttcacattcttccaccaattgaaagttttgtatcttacagttctttttttaaataatatatttattgagcactttctatctactagtcactgtgatacagtataagtaaagtgggttgtctcatttaatattcagaataaccacatgaagtatgaactgccattatctttcccctttgtacaaatgaggaaagtgaggctcacagaagttaattggcccagggtcccacaactagtcagtgcagaggtgggaaacataaccagatttgttcggcatgaacttgtgccaaatttcctccaaagttctcaaaaggcaaggcatgttattttatcccaatttagcataccaacaactataatactagatatgtaggaaagtgcttaataatcgttttttactgatgattcagtgtctaaattttgaacaaatttgggtaagatacaagtcacacataaattgacagaaaatgtagttcttcattcaatggttagcagtcattaaaaggtactttccctttgtttgtggtgataatcagtattagtagttttcatattatttggcttccatattaatcatttttatattttcttctccttcttaccatgtttacttatatcatccatcttttagaatcccagggagctaatttctggtccctgtgttgctatcaaatctgtatcttgcagaaagaataatttatttcaaacaagggacatacaatagaaagataagacctactgaggtctttttcccatcattttattatgaaaaatgttcaaacatacagtaaaattgaaagaattttatagtaaatactgaccacggggattctacatcttactctacttgttttattattttcctatccagcgtactttttgatggatttcaaaataaattgcagttgctgatatacttccccctagtacttcaactgcagattattaactagagtttagtatttatttagtttttaaatttttttgatttaagatttacctgcaataaaatgtacaaatcttaagtataaatttactgagttcttgcagacatatacacctgtgtaacccaaaccctttccaaaatttagaccattgcaatcatcttcagaaagtttcctaaatccctctcccagtctatcccctccccacccctcaggtataactactgttctcattcttttatatcaaaggttaaatttacctgttctaaacttcatatgagtgaaattatacaaaatgtaatgcttctttcacttagcataatgtttttgagatttattcatgttgttgcatgtgtcagtgattcatttctttttattgctgagtattctttcgtatgaatatatcacagtttgtttttttatctttctgttgatggacactgggctctttctgcttgttttttactgttatgaataaagctgctatgaacattcttagacaa

SEQ ID NO: 1825 - DNA, 5613 bp, Homo sapiens
actaggaactacatttcccggtgagagagcggctccggccggccgcgcggtaccggagcgtcgcactgtcagcggccagagagcctggggcagatcgaaaagggagtgcttcttcccttctctccgcgctctggcggtgcaagcggctctgctttccctcgccccgccgtcgggtgctccctgcccgcctccccgtgtcagctttccctgggccccgccgggaaagtctgggcctcgaaattcgaaggcagcggcggctgcccagcacgggagtgtggggcgcgccactcggcggcccagcctacccagggcccggcccgcgcctccatgggcccgacccggaagcccaacgtgtgcagccggctgagtcgccgggcgctgggctgcttctcgcgcgacgcaggcgtggtgcagaggaccaacctgggcatcctgcgggcgctggtgtgccaggaaagtactaaatttaagaatgtctggacaactcattccaggtcacctatagcctatgagagaggaagaatatattttgacaattatcggcgctgtgtcagcagtgttgcatctgagccaagaaaactttatgaaatgccaaaatgttccaaatcagaaaaaatagaggatgctttattatgggaatgcccagtgggagatatacttcccaattcatcagattataagtcctcactcatagcactgactgctcataattggctacttcgtatatcagcaactacgggaaaaatccttgagaaaatatatcttgcaccttattgcaaattcagatacttgagctgggacactcctcaagaagtcattgcagttaagtcagctcagaacagaggctcagcagtggcccggcaggcaggcattcaacaacatgttttgctgtaccttgcagtgttccgagttctacctttttcacttgtagggattctagagatcaacaaaaagacatgccaccactgctctttgaggtgtcatccctggagaatgcttttcagattggaggccatccttggcactacatcgtcacacctaataagaagaaacagaaaggagttttccatatttgtgccctaaaagacaattccctggcaaaaaatgggatccaagaaatggattgttgttctctagaatctgactggatctatttccatcctgatgcttctggtagaataatacatgttggtccaaatcaagtcaaagttttgaagctaactgaaatagaaaataatagttctcagcatcagatctctgaagattttgtcattttggccaacagggagaaccataaaaatgaaaatgtactcactgttacagcttctggacgggtggtaaaaaaaagttttaaccttctggatgatgacccagaacaagagactttcaaaattgtggactatgaagatgagttagatttgctttctgtggtagctgttactcaaatagatgctgaaggaaaagctcacctggatttccactgtaatgaatatggaactttacttaaaagcattccactagtggagtcatgggatgtgacatatagccatgaagtctactttgacagagacttggtgctacacatagagcagaaacccaacagagtcttcagctgctatgtttaccagatgatatgtgacactggggaagaagaagaaaccataaacagaagctgttaaaaagagtgagataattgtaacctaagagacttttagccaaacaccccagcagctgcgtccaatccattttattatctgcatggcacattctccagtattttccaaaaaagtcttgtgttgacttcagatgactatgacttcttttttaaactcttgctgtaaaagatggtgaggacttcattttttttaaaggttttttagaatactgttccaagaagtttagtgttttgcagctttgagctaggtggtaatgcaaatataaaatgctgggaacagaaaaggacaggttaattccaattgttgaggagttaagtcattgatggggtgggtcattgatgagttcttaaaggatggtatggaattttgtttgttaaggctaggaaagacagggagagacaaaagtaaacatgcagaaagaaatcttatatcctctataccaaactttgcttaaggatgagaaatgagatgtgttatgtgagaacattattttgagcccaaaatgtgtcatcacagtttttaaaaatcttatatatgtatttatatgtgtttcgtatttgtatatagtatcaggaattggttctagttcccaaattatcttttcttccttggttttgttctcttggcttgatgttcacattgaatatttgtgtttctatataggctaatgtaaaagattccaagcaaaccttaagtgaaattgttttctgatttgcatcctgtttagctcttaatgtatctaaggatgttctcatctcaccattctactcatttagtgagttttctgatcttgtttaggcaatatttgcatacttatgcaataagataaaggtacccttgcctgcagtagttctgtttcctgtagaaaagtggataaagagtcccagaagaagttcttactagcttgggagttacctgattaaccagagaaaatttttggcttacttatggaacaagcattatttcttctttgttaggaaagatctaaatatggtccttgacttttaataatcattctttagaatgttaaataaaggcaacccaagtaaagggagaaaatgtttctttgtgcttcctgtttgagaaattcagttgcttccatttcgcatgttctgcacatttatccgatgtaacctcaaaagaataactggtaataagggaaggaaacagcagcaacaatcattgctgattcaagtttaaggttaaaatatggaatttttagcttggatgatttatattaaaatctttccattttttttttcagttttggcttgatgccatgttaagaatgatgtgaattcttcccagttctgccctggtgctagacattgccccatactttcaattagacactagctgtatctaaatagtcccactcagtaaacttacatcttgaaaaacaagaccagtaagaggccagtgaaagtactaaagaaagaaaccaatgttgtgtgagtttcaaagcagctgcaatgctgtgtaaaagtagagtgttcattctccatttccaagagtgtttcagaataggatgtcttaagacttcagtcatgtcagagatttttttttttaggtgattattgagtttctccttctcctttaagtcatcaccttccttttatgaaatgatagtaaggaactcgtctattctgaaaggcatttgagaaatagctgaattcctggctgcttttttgctgggggtagatggtggaatacttctggtctagatataacttaccactaagaaacccccagtatgtcaccactgcctaaatctaactagaccagggtccaaatgccatccaggccaggcaggaaatatacctcatgtgaaagacagtaaggagttgtgggcagtgtaacaaacaggagagctatgccccaactaaaaggagcagctgctactgcttagtttcagccagttgcaacagtatgtgggaatgtaggctgcatggttgttaacaagatagatggtaaaaagatgccagaagatacagaagatagcaaagaatgtggggaatttggataccacacatagcgagagacaatgaagcatgcttcccagctcgccagagtgtcacacagctgctcattctgccacctgccagacattaatgtcttcctgccctacctaaaccccctctttacctgatattttaattcgagactctagctacatgcccacctacttaacaggtactagtgacaggtacaaaacattatgggtaacaattctgagtgtttaatgcaagcccaggtgaagcagggtagcttccatcagcaggtacagacgttacgctgaaaagaggtgcattctgcattgcactcctggatctaagtttctgcattctcagagcatcaatgcagcaagcttattgttcctcaattttttacaatatttatcacaactctgggagaaaacaaaacaaatcctatcctatttactatttgtgctacctagtgaggagataccgctctgtttagacaaattaaggcacttcacattcttccaccaattgaaagttttgtatcttacagttctttttttaaataatatatttattgagcactttctatctactagtcactgtgatacagtataagtaaagtgggttgtctcatttaatattcagaataaccacatgaagtatgaactgccattatctttcccctttgtacaaatgaggaaagtgaggctcacagaagttaattggcccagggtcccacaactagtcagtgcagaggtgggaaacataaccagatttgttcggcatgaacttgtgccaaatttcctccaaagttctcaaaaggcaaggcatgttattttatcccaatttagcataccaacaactataatactagatatgtaggaaagtgcttaataatcgttttttactgatgattcagtgtctaaattttgaacaaatttgggtaagatacaagtcacacataaattgacagaaaatgtagttcttcattcaatggttagcagtcattaaaaggtactttccctttgtttgtggtgataatcagtattagtagttttcatattatttggcttccatattaatcatttttatattttcttctccttcttaccatgtttacttatatcatccatcttttagaatcccagggagctaatttctggtccctgtgttgctatcaaatctgtatcttgcagaaagaataatttatttcaaacaagggacatacaatagaaagataagacctactgaggtctttttcccatcattttattatgaaaaatgttcaaacatacagtaaaattgaaagaattttatagtaaatactgaccacggggattctacatcttactctacttgttttattattttcctatccagcgtactttttgatggatttcaaaataaattgcagttgctgatatacttccccctagtacttcaactgcagattattaactagagtttagtatttatttagtttttaaatttttttgatttaagatttacctgcaataaaatgtacaaatcttaagtataaatttactgagttcttgcagacatatacacctgtgtaacccaaaccctttccaaaatttagaccattgcaatcatcttcagaaagtttcctaaatccctctcccagtctatcccctccccacccctcaggtataactactgttctcattcttttatatcaaaggttaaatttacctgttctaaacttcatatgagtgaaattatacaaaatgtaatgcttctttcacttagcataatgtttttgagatttattcatgttgttgcatgtgtcagtgattcatttctttttattgctgagtattctttcgtatgaatatatcacagtttgtttttttatctttctgttgatggacactgggctctttctgcttgttttttactgttatgaataaagctgctatgaacattcttag

SEQ ID NO: 1826 - DNA, 5623 bp, Homo sapiens
actaggaactacatttcccggtgagagagcggctccggccggccgcgcggtaccggagcgtcgcactgtcagcggccagagagcctggggcagatcgaaaagggagtgcttcttcccttctctccgcgctctggcggtgcaagcggctctgctttccctcgccccgccgtcgggtgctccctgcccgcctccccgtgtcagctttccctgggccccgccgggaaagtctgggcctcgaaattcgaaggcagcggcggctgcccagcacgggagtgtggggcgcgccactcggcggcccagcctacccagggcccggcccgcgcctccatgggcccgacccggaagcccaacgtgtgcagccggctgagtcgccgggcgctgggctgcttctcgcgcgacgcaggcgtggtgcagaggaccaacctgggcatcctgcgggcgctggtgtgccaggaaagtactaaatttaagaatgtctggacaactcattccaggtcacctatagcctatgagagaggaagaatatattttgacaattatcggcgctgtgtcagcagtgttgcatctgagccaagaaaactttatgaaatgccaaaatgttccaaatcagaaaaaatagaggatgctttattatgggaatgcccagtgggagatatacttcccaattcatcagattataagtcctcactcatagcactgactgctcataattggctacttcgtatatcagcaactacgggaaaaatccttgagaaaatatatcttgcaccttattgcaaattcagatacttgagctgggacactcctcaagaagtcattgcagttaagtcagctcagaacagaggctcagcagtggcccggcaggcaggcattcaacaacatgttttgctgtaccttgcagtgttccgagttctacctttttcacttgtagggattctagagatcaacaaaaagatttttgggaacgttacagatgctaccttgtctcatggaatactgattgtgatgtacagctcaggactggtcagactctatagcttccaaaccatcgctgaacagttcatgcaacagaaacttgacttagggtgtgcatgcagatggggtgggactactggaactgtaggagaggctccttttggcattccttgtaatattaaaatcacagacatgccaccactgctctttgaggtgtcatccctggagaatgcttttcagattggaggccatccttggcactacatcgtcacacctaataagaagaaacagaaaggagttttccatatttgtgccctaaaagacaattccctgaatgaaaatgtactcactgttacagcttctggacgggtggtaaaaaaaagttttaaccttctggatgatgacccagaacaagagactttcaaaattgtggactatgaagatgagttagatttgctttctgtggtagctgttactcaaatagatgctgaaggaaaagctcacctggatttccactgtaatgaatatggaactttacttaaaagcattccactagtggagtcatgggatgtgacatatagccatgaagtctactttgacagagacttggtgctacacatagagcagaaacccaacagagtcttcagctgctatgtttaccagatgatatgtgacactggggaagaagaagaaaccataaacagaagctgttaaaaagagtgagataattgtaacctaagagacttttagccaaacaccccagcagctgcgtccaatccattttattatctgcatggcacattctccagtattttccaaaaaagtcttgtgttgacttcagatgactatgacttcttttttaaactcttgctgtaaaagatggtgaggacttcattttttttaaaggttttttagaatactgttccaagaagtttagtgttttgcagctttgagctaggtggtaatgcaaatataaaatgctgggaacagaaaaggacaggttaattccaattgttgaggagttaagtcattgatggggtgggtcattgatgagttcttaaaggatggtatggaattttgtttgttaaggctaggaaagacagggagagacaaaagtaaacatgcagaaagaaatcttatatcctctataccaaactttgcttaaggatgagaaatgagatgtgttatgtgagaacattattttgagcccaaaatgtgtcatcacagtttttaaaaatcttatatatgtatttatatgtgtttcgtatttgtatatagtatcaggaattggttctagttcccaaattatcttttcttccttggttttgttctcttggcttgatgttcacattgaatatttgtgtttctatataggctaatgtaaaagattccaagcaaaccttaagtgaaattgttttctgatttgcatcctgtttagctcttaatgtatctaaggatgttctcatctcaccattctactcatttagtgagttttctgatcttgtttaggcaatatttgcatacttatgcaataagataaaggtacccttgcctgcagtagttctgtttcctgtagaaaagtggataaagagtcccagaagaagttcttactagcttgggagttacctgattaaccagagaaaatttttggcttacttatggaacaagcattatttcttctttgttaggaaagatctaaatatggtccttgacttttaataatcattctttagaatgttaaataaaggcaacccaagtaaagggagaaaatgtttctttgtgcttcctgtttgagaaattcagttgcttccatttcgcatgttctgcacatttatccgatgtaacctcaaaagaataactggtaataagggaaggaaacagcagcaacaatcattgctgattcaagtttaaggttaaaatatggaatttttagcttggatgatttatattaaaatctttccattttttttttcagttttggcttgatgccatgttaagaatgatgtgaattcttcccagttctgccctggtgctagacattgccccatactttcaattagacactagctgtatctaaatagtcccactcagtaaacttacatcttgaaaaacaagaccagtaagaggccagtgaaagtactaaagaaagaaaccaatgttgtgtgagtttcaaagcagctgcaatgctgtgtaaaagtagagtgttcattctccatttccaagagtgtttcagaataggatgtcttaagacttcagtcatgtcagagatttttttttttaggtgattattgagtttctccttctcctttaagtcatcaccttccttttatgaaatgatagtaaggaactcgtctattctgaaaggcatttgagaaatagctgaattcctggctgcttttttgctgggggtagatggtggaatacttctggtctagatataacttaccactaagaaacccccagtatgtcaccactgcctaaatctaactagaccagggtccaaatgccatccaggccaggcaggaaatatacctcatgtgaaagacagtaaggagttgtgggcagtgtaacaaacaggagagctatgccccaactaaaaggagcagctgctactgcttagtttcagccagttgcaacagtatgtgggaatgtaggctgcatggttgttaacaagatagatggtaaaaagatgccagaagatacagaagatagcaaagaatgtggggaatttggataccacacatagcgagagacaatgaagcatgcttcccagctcgccagagtgtcacacagctgctcattctgccacctgccagacattaatgtcttcctgccctacctaaaccccctctttacctgatattttaattcgagactctagctacatgcccacctacttaacaggtactagtgacaggtacaaaacattatgggtaacaattctgagtgtttaatgcaagcccaggtgaagcagggtagcttccatcagcaggtacagacgttacgctgaaaagaggtgcattctgcattgcactcctggatctaagtttctgcattctcagagcatcaatgcagcaagcttattgttcctcaattttttacaatatttatcacaactctgggagaaaacaaaacaaatcctatcctatttactatttgtgctacctagtgaggagataccgctctgtttagacaaattaaggcacttcacattcttccaccaattgaaagttttgtatcttacagttctttttttaaataatatatttattgagcactttctatctactagtcactgtgatacagtataagtaaagtgggttgtctcatttaatattcagaataaccacatgaagtatgaactgccattatctttcccctttgtacaaatgaggaaagtgaggctcacagaagttaattggcccagggtcccacaactagtcagtgcagaggtgggaaacataaccagatttgttcggcatgaacttgtgccaaatttcctccaaagttctcaaaaggcaaggcatgttattttatcccaatttagcataccaacaactataatactagatatgtaggaaagtgcttaataatcgttttttactgatgattcagtgtctaaattttgaacaaatttgggtaagatacaagtcacacataaattgacagaaaatgtagttcttcattcaatggttagcagtcattaaaaggtactttccctttgtttgtggtgataatcagtattagtagttttcatattatttggcttccatattaatcatttttatattttcttctccttcttaccatgtttacttatatcatccatcttttagaatcccagggagctaatttctggtccctgtgttgctatcaaatctgtatcttgcagaaagaataatttatttcaaacaagggacatacaatagaaagataagacctactgaggtctttttcccatcattttattatgaaaaatgttcaaacatacagtaaaattgaaagaattttatagtaaatactgaccacggggattctacatcttactctacttgttttattattttcctatccagcgtactttttgatggatttcaaaataaattgcagttgctgatatacttccccctagtacttcaactgcagattattaactagagtttagtatttatttagtttttaaatttttttgatttaagatttacctgcaataaaatgtacaaatcttaagtataaatttactgagttcttgcagacatatacacctgtgtaacccaaaccctttccaaaatttagaccattgcaatcatcttcagaaagtttcctaaatccctctcccagtctatcccctccccacccctcaggtataactactgttctcattcttttatatcaaaggttaaatttacctgttctaaacttcatatgagtgaaattatacaaaatgtaatgcttctttcacttagcataatgtttttgagatttattcatgttgttgcatgtgtcagtgattcatttctttttattgctgagtattctttcgtatgaatatatcacagtttgtttttttatctttctgttgatggacactgggctctttctgcttgttttttactgttatgaataaagctgctatgaacattcttag

SEQ ID NO: 1827 - DNA, 1306 bp, Homo sapiens
ggcctatgagatcccggcctcagggtggacgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcacattta

SEQ ID NO: 1828 - DNA, 1128 bp, Homo sapiens
ggcctatgagatcccggcctcagggtggacgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggtaagccctggaacgtggcctgctgtgtgcagtgtggccaggggtctgtggctagcagagaggacctgccctaaagatagagtcttgatgcaccgtctaccttgtccccaaccaagagtgagtagtgcacagaagtctcctggcaccctgggaatcctgcatttttaatggacgaacaggcaggaaagaaaaaaaaaacccaaaccccatcactctgccagcccctgtgaccaaagcagcccaaatcagttaccttgacaactctcatgcacagactgcaccagcctgtgttgcaaacatcactgccccgcttctaacaggaagagatactcttttggggg

SEQ ID NO: 1829 - DNA, 972 bp, Homo sapiens
acgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggtaagccctggaacgtggcctgctgtgtgcagtgtggccaggggtctgtggctagcagagaggacctgccctaaagatagagtcttgatgcaccgtctaccttgtccccaaccaagagtgagtagtgcacagaagtctcctggcaccctgggaatcctgcatttttccctcatcgcctggggccgggagtcccctgcccaagccccagcctga

SEQ ID NO: 1830 - DNA, 552 bp, Homo sapiens
acagctggcattcagcctccagagcaccagcactggcactggcactggcacacgctatggcaaatgaagtgcaagacctgctctcccctcggaaagggggacatcctcctgcagtaaaagctggaggaatgagaatttccaaaaaacaagaaattggcaccttggaaagacataccaaaaaaacaggattcgagaaaacaagtgccattgcaaatgttgccaaaatacagacactggatgccctgaatgacgcactggagaagctcaactataaatttccagcaacagtgcacatggcgcatcaaaaacccacacctgctctggaaaaggttgttccactgaaaaggatctacattattcagcagcctcgaaaatgttaagcctggatttaaaacacagccgtctggccagctgcctcgaatatctgacagcttagcaaaaagggccaaagctttccataggcgtgctgcacttgcttggtaaattaagcagcttttgtatcttcccctttgactttaggtaataaagcatccaaacttgtaaatctgacac

SEQ ID NO: 1831 - DNA, 5159 bp, Homo sapiens
cagggccggtgggatcccctcgggctcccgccttagcatgctggccgggacatctggtgaacatggcctctgctactgcggcagcagcacgacggggcctcggccgggctctccctctcttctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatcgtggtttgccaggagacggatgacacctacatccccctgaaccatatggacccaaatcagaaggggtttctagaggtcagcaacagcccactgtcagaagaggccgtcctgggatttgaatatgggatgagcattgagagcccaaagttactgcccctgtgggaggcacagtttggcgatttcttcaatggtgcccagatcatctttgacacattcatctctggaggagaggccaagtggctcctacaaagcggcatcgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgtctccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgagatgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctca

SEQ ID NO: 1832 - DNA, 482 bp, Homo sapiens
ggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcaggtacaattataaacccttgtgtgatatgcc

SEQ ID NO: 1833 - DNA, 933 bp, Homo sapiens
tctggtgaacatggcctctgctactgcggcagcagcacgacggggcctcggccgggctctccctctcttctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactcc

SEQ ID NO: 1834 - DNA, 787 bp, Homo sapiens
caaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatcgtggtttgccaggagacggatgacacctacatccccctgaaccatatggacccaaatcagaaggggtttctagaggagaggccaagtggctcctacaaagcggcatcgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactca

SEQ ID NO: 1835 - DNA, 1480 bp, Homo sapiens
tactacgtcatagttccgcgccgccccagccgggcggggtgggtgtgtcacccagatcgctccgcccccatccgcaggttctaactttggcctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaa

SEQ ID NO: 1836 - DNA, 1470 bp, Homo sapiens
agatagcccaggactctgcgtggacgcgccccgaggggctgccgcgccagattcccatatccaggcagccacactcagagggttgtagtagttgtccacctctggacagtcccactcagccccttcttcactctctgggcctcccaaaagacagtcagccttgtcctcaggcccgcacccagttgtcagcctctgactcctctcccctcaaaggattcttaccttggctcctcctcttagccctaacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttc

SEQ ID NO: 1837 - DNA, 1243 bp, Homo sapiens
ttcatatcaggttcttccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactagaaataaacatctcaaacagt

SEQ ID NO: 1838 - DNA, 1375 bp, Homo sapiens
gaggcgggaggatgaagttgattgactatggtctctccggctaccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactagaaataaacatctcaaacagtaagagttgtagtcttccaggactagaaccttgtgtcctttgaattctcgccctgccagctcctagaaatagtttcaatcttggaatcagatgttatgtcacctga

SEQ ID NO: 1839 - DNA, 7447 bp, Homo sapiens
gggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctctagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 1840 - DNA, 1837 bp, Homo sapiens
ttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgcggtaaaatcagtaaagttggaagtggatgaagataagagcacaaagggatccaatttttccaactcggaagtggcaattggtttgtctccttacacctttccccagaagaggcttttccatgttgctggagaagaaaacatcacctaggccggtgtgtgcctggcagaacactgcactccaatttcctcgggcagccac

SEQ ID NO: 1841 - DNA, 4392 bp, Homo sapiens
gaggctgcggccacgaggaagaggggcggggggcggagcctgggaatggggcggggccggagaacagcccgtcgctaaggcctgcgacccagacagcggggaggaggcggtgccgcccgctctggccccgcccctcggggggtgggcccagcgggagggcccggctggcggagcgcgcgggagacagttcgctccgactgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacaccctt

SEQ ID NO: 1842 - DNA, 2101 bp, Homo sapiens
ggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttccaccattcaaa

SEQ ID NO: 1843 - DNA, 1345 bp, Homo sapiens
gccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatc

SEQ ID NO: 1844 - DNA, 957 bp, Homo sapiens
gccgggagaggacgccggagggaaaggaagggggagcgcgcccagcatcgcttgggcctcctccacccgctcaggaggggaaacaggagagccgggagcacaacagcctcgcgcgcccgccgccgcctcagccttaggggaggccactacgcctctggttacatttcttgatcatggtatctccccagctagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaat

SEQ ID NO: 1845 - DNA, 2038 bp, Homo sapiens
agcgattttcctgcctcagccttccgagtagctgggattacaggcgcgcaccaccacgcctggctaatttctgtatttttaatagagacgggtttcaccatgttggccaggctggtctcgaactcctgacctcaggtgatccgcccgcctcagcctcccaaagtgctggaattataggcgtgagcccaccgagcttggctgggtccttgtcttgaaatgtgtctctgagccattagccagaagggggcaaagaggcctggagggcagctttcccccactccccctccgttactctctgaatctgagctccaggtttgggcagttgaggtttagcctgaggccaaggacgaacgtgatggggtacaggagaagacttggcggtggagggggttttgtgtgcacatttacagagtcaggggcattcccagtccagaaaggattctcagaggcagtcacaaaaaggaatggggtggaagggctgagacttgagggagggaagggtggtgggggtagggccggggtgtggttgggtggatcgggttgatatttatatagggataggttgatcttggaaggctggagacggcaacgtggacaggaagaagcggagggcgaggaggagcagaggagcacacagatgaagcaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgc

SEQ ID NO: 1846 - DNA, 1572 bp, Homo sapiens
gaggagcagccgctgccgccgctcggggtcgcctggagccccagattcccgagcgctcggctcgcatggcagccgcttcggcgcccggccccgcggccagctaggggcggccccgcgctccctcacggcccctcggcggcgcccgtcggatccggcctctctctgcgccccggggcgcgccacctccccgccggaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaa

SEQ ID NO: 1847 - DNA, 1590 bp, Homo sapiens
gaggagcagccgctgccgccgctcggggtcgcctggagccccagattcccgagcgctcggctcgcatggcagccgcttcggcgcccggccccgcggccagctaggggcggccccgcgctccctcacggcccctcggcggcgcccgtcggatccggcctctctctgcgccccggggcgcgccacctccccgccggaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaa

SEQ ID NO: 1848 - DNA, 1323 bp, Homo sapiens
ggcaacgtggacaggaagaagcggagggcgaggaggagcagaggagcacacagatgaagcaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaa

SEQ ID NO: 1849 - DNA, 2020 bp, Homo sapiens
agcgattttcctgcctcagccttccgagtagctgggattacaggcgcgcaccaccacgcctggctaatttctgtatttttaatagagacgggtttcaccatgttggccaggctggtctcgaactcctgacctcaggtgatccgcccgcctcagcctcccaaagtgctggaattataggcgtgagcccaccgagcttggctgggtccttgtcttgaaatgtgtctctgagccattagccagaagggggcaaagaggcctggagggcagctttcccccactccccctccgttactctctgaatctgagctccaggtttgggcagttgaggtttagcctgaggccaaggacgaacgtgatggggtacaggagaagacttggcggtggagggggttttgtgtgcacatttacagagtcaggggcattcccagtccagaaaggattctcagaggcagtcacaaaaaggaatggggtggaagggctgagacttgagggagggaagggtggtgggggtagggccggggtgtggttgggtggatcgggttgatatttatatagggataggttgatcttggaaggctggagacggcaacgtggacaggaagaagcggagggcgaggaggagcagaggagcacacagatgaagcaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgc

SEQ ID NO: 1850 - DNA, 1056 bp, Homo sapiens
ctggctgccagcacggtacctgccaccagccatggcagtgcatctgccacagtggctgggcaggcaagttctgtgacaaaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaa
